US012049630B2

(12) United States Patent
Schmidt et al.

(10) Patent No.: US 12,049,630 B2
(45) Date of Patent: Jul. 30, 2024

(54) FACTOR XII (F12) iRNA COMPOSITIONS AND METHODS OF USE THEREOF

(71) Applicant: Alnylam Pharmaceuticals, Inc., Cambridge, MA (US)

(72) Inventors: Karyn Schmidt, Cambridge, MA (US); Mark K. Schlegel, Boston, MA (US); Adam Castoreno, Framingham, MA (US)

(73) Assignee: Alnylam Pharmaceuticals, Inc., Cambridge, MA (US)

( * ) Notice: Subject to any disclaimer, the term of this patent is extended or adjusted under 35 U.S.C. 154(b) by 0 days.

(21) Appl. No.: 18/507,183

(22) Filed: Nov. 13, 2023

(65) Prior Publication Data

US 2024/0132896 A1    Apr. 25, 2024

Related U.S. Application Data

(63) Continuation of application No. PCT/US2022/074910, filed on Aug. 12, 2022.

(60) Provisional application No. 63/232,840, filed on Aug. 13, 2021.

(51) Int. Cl.
*C12N 15/113* (2010.01)
*A61K 31/713* (2006.01)
*A61K 47/54* (2017.01)

(52) U.S. Cl.
CPC ........ *C12N 15/1137* (2013.01); *A61K 47/549* (2017.08); *C12N 2310/14* (2013.01); *C12N 2310/351* (2013.01); *C12N 2310/353* (2013.01)

(58) Field of Classification Search
CPC ...... C12N 15/33; A61K 31/713; A61K 45/06; A61K 47/549
See application file for complete search history.

(56) References Cited

U.S. PATENT DOCUMENTS 9,803,205 B2   10/2017   Kanner et al.
10,883,107 B2   1/2021   Hinkle
10,934,544 B2   3/2021   Akinc et al.
(Continued)

FOREIGN PATENT DOCUMENTS

CN       102600471 A    7/2012
EP         1752536 A1    2/2007
(Continued)

OTHER PUBLICATIONS

EMBL Database Accession No. FW736821; Sequence 143347 from PCT Publication No. WO 2005/116204.
(Continued)

*Primary Examiner* — Terra C Gibbs
(74) *Attorney, Agent, or Firm* — McCarter & English, LLP; Maria Laccotripe Zacharakis; Deborah L. Nagle

(57) ABSTRACT

The present invention relates to RNAi agents, e.g., double stranded RNA (dsRNA) agents, targeting the Factor XII (F12) gene. The invention also relates to methods of using such RNAi agents to inhibit expression of an F12 gene and to methods of preventing and treating an F12-associated disorder, e.g., heredity angioedema (HAE), prekallikrein deficiency, malignant essential hypertension, hypertension, end stage renal disease, Fletcher Factor Deficiency, thromboembolic disease, inflammatory disease, or Alzheimer's Disease.

30 Claims, 2 Drawing Sheets

Specification includes a Sequence Listing.

(56) References Cited

U.S. PATENT DOCUMENTS

| | | | |
|---|---|---|---|
| 2007/0031844 A1* | 2/2007 | Khvorova | A61P 3/10 435/6.13 |
| 2008/0113351 A1 | 5/2008 | Naito et al. | |
| 2011/0178283 A1 | 7/2011 | Rigoutsos et al. | |
| 2015/0368642 A1 | 12/2015 | Albæk et al. | |
| 2016/0272970 A1 | 9/2016 | Rozema et al. | |
| 2016/0272978 A1* | 9/2016 | Kanner | A61K 47/554 |
| 2018/0100150 A1 | 4/2018 | Akinc et al. | |
| 2019/0264210 A1 | 8/2019 | Kole et al. | |
| 2020/0208150 A1 | 7/2020 | Butler et al. | |
| 2021/0222176 A1 | 7/2021 | Hinkle | |
| 2021/0246447 A1 | 8/2021 | Akinc et al. | |
| 2022/0267767 A1 | 8/2022 | Butler et al. | |

FOREIGN PATENT DOCUMENTS

| | | |
|---|---|---|
| WO | WO-2007059966 A1 | 5/2007 |
| WO | WO-2007130604 A2 | 11/2007 |
| WO | WO-2009053050 A1 | 4/2009 |
| WO | WO-2012170947 A2 | 12/2012 |
| WO | WO-2016149331 A2 | 9/2016 |
| WO | WO-2016179342 A2 | 11/2016 |
| WO | WO-2017120397 A1 | 7/2017 |
| WO | WO-2018098328 A1 | 5/2018 |
| WO | WO-2018140920 A1 | 8/2018 |
| WO | WO-2019010342 A1 | 1/2019 |
| WO | WO-2023019246 A1 | 2/2023 |

OTHER PUBLICATIONS

Cai et al., "Factor XII full and partial null in rat confers robust antithrombotic efficacy with no bleeding," Blood Coagulation & Fibrinolysis, 2015, 26:893-902.

International Search Report from PCT/US2016/030876 dated Nov. 28, 2016.

Papageorgiou et al. "Coagulation Factor XIIa-kinin-mediated contribution to hypertension of chronic kidney disease," Journal of Hypertension, 2014, 32(7):1523-1533.

International Search Report from PCT/US2017/012420 dated Mar. 1, 2017.

European Search Report from EP Application No. 17736380.1 dated Jun. 18, 2019.

Reynolds et al., "Rational siRNA design for RNA interference," Nature Biotechnology, vol. 22, pp. 326-330, 2004.

Allerson et al., "Fully 2'-Modified Oligonucleotide Duplexes with Improved in Vitro Potency and Stability Compared to Unmodified Small Interfering RNA", J. Med. Chem.48(4):901-904, 2005.

Bhattacharjee et al., "Inhibition of Vascular Permeability by Antisense-Mediated Inhibition of Plasma Kallikrein and Coagulation Factor 12", Nucleic Acid Therapeutics, vol. 23, No. 3, Jun. 1, 2013, pp. 175-187.

Vickers et al., "Efficient Reduction of Target RNAs by Small Interfering RNA and RNase H-dependent Antisense Agents", JBC, vol. 278, No. 9, 7108-7118, 2003.

Kenne et al., "Factor XII: a drug target for safe interference with thrombosis and inflammation", Drug Discovery Today., US, (Sep. 1, 2014), vol. 19, No. 9, pp. 1459-1464.

Davidkova et al., "Pharmacological Inhibition of Dopaminergic and Other Neurotransmitter Receptors Using Antisense Oligodeoxynucleotides" in, Antisense Research and Applications, 1993, CRC Press. p. 263-308.

Zhu et al. "Proof-of-concept Studies for siRNA-mediated Gene Silencing for Coagulation Factors in Rat and Rabbit", Molecular Therapy—Nucleic Acids, vol. 4, No. 1, Jan. 27, 2015, p. e224, XP055285909;—& Chen Zhu et al: "Supplementary Material: Proof-of-concept Studies for si RNA-mediated Gene Silencing for Coagulation Factors in Rat and Rabbit", Molecular Therapy—Nucleic Acids, Jan. 27, 2015, XP55888224;—& Chen Zhu et al: "Supplementary Figure 3: Proof-of-concept Studies for siRNA-mediated Gene Silencing for Coagulation Factors in Rat and Rabbit",Molecular Therapy—Nucleic Acids, Jan. 27, 2015.

Zhang et al. "Coagulation Factor X Regulated by CASC2c Recruited Macrophages and Induced M2 Polarization in Glioblastoma Multiforme", Frontiers in Immunology, vol. 9, Jul. 6, 2018.

Ankrom et al. "Preclinical and translational evaluation of coagulation factor IXa as a novel therapeutic target", Pharmacology Research & Perspectives, vol. 4, No. 1, Jan. 15, 2016.

Hu et al. "Therapeutic siRNA: state of the art", Signal Transduction and Targeted Therapy, vol. 5, No. 1, Jun. 19, 2020.

International Search Report and Written Opinion from PCT/US2018/, dated Oct. 2, 2018.

International Search Report and Written Opinion from PCT/US2018/040967, dated Oct. 2, 2018.

\* cited by examiner

FACTOR XII (F12) iRNA COMPOSITIONS AND METHODS OF USE THEREOF

RELATED APPLICATIONS

This application is a 35 § U.S.C. 111(a) continuation application which claims the benefit of priority to PCT/US2022/074910, filed on Aug. 12, 2022, which, in turn, claims the benefit of priority to U.S. Provisional Application No. 63/232,840, filed on Aug. 13, 2021. The entire contents of each of the foregoing applications are incorporated herein by reference.

SEQUENCE LISTING

The application contains a Sequence Listing which has been submitted electronically in .XML format and is hereby incorporated by reference in its entirety. Said .XML copy, created on Nov. 9, 2023, is named "121301_16602_SL.xml" and is 4,023,940 bytes in size. The sequence listing contained in this .XML file is part of the specification and is hereby incorporated by reference herein in its entirety.

BACKGROUND OF THE INVENTION

Hereditary Angioedema (HAE) is a rare autosomal dominant disorder that causes recurrent edema and swelling of the extremities, face, larynx, upper respiratory tract, abdomen, trunk, and genitals and a nonpruritic rash in one-third of patients. Untreated HAE patients experience an average of one-to-two angioedema attacks per month, but the frequency and severity of episodes can vary significantly. Edema swelling is often disfiguring and disabling, results in frequent hospitalization, and patients may require psychiatric care to treat disease-associated anxiety. Abdominal attacks can cause severe pain, nausea and vomiting, and may lead to inappropriate surgeries. Furthermore, over half of HAE patients also experience life-threatening laryngeal edema during their lifetime that may require emergency tracheostomy to prevent asphyxiation. HAE affects an estimated 6,000 to 10,000 individuals of varying ethnic groups in the United States and causes significant economic harm to patients, accounting for 15,000 to 30,000 hospital visits and 20 to 100 sick days per year.

HAE results from a mutation of the C1 inhibitor (C1INH, SERPING1) gene that results in a deficiency of C1INH protein. Over 250 different C1INH mutations have been demonstrated to cause an HAE clinical presentation. These C1INH mutations are typically inherited genetically, however, up to 25% of HAE cases result from de novo mutation of C1INH. HAE type I is caused by C1INH mutations that result in lower levels of truncated or misfolded proteins that are inefficiently secreted, and accounts for approximately 85% of HAE cases. HAE type II constitutes about 15% of cases and is caused by mutations near the active site of C1INH that result in normal levels of dysfunctional C1INH protein. HAE type III, a rare third form the disease, occurs as a result of a gain-of-function mutation in coagulation factor XII (F12) (Hageman Factor).

C1 inhibitor is a serine protease inhibitor of the serpin family and a major inhibitor of proteases in the complement and contact activation pathways, as well as a minor inhibitor of fibrinolytic protease plasmin. These plasma proteolytic cascades are activated during an HAE attack, generating substances that increase vascular permeability. Studies have shown that the bradykinin peptide, which activates proinflammatory signaling pathways that dilate vessels and induces chemotaxis of neutrophils, is the primary substance that enhances vascular permeability in an HAE attack by binding to the bradykinin receptor on vascular endothelial cells. The formation of bradykinin in plasma generally requires interaction of three proteins, namely F12, prekallikrein and high-molecular-weight kininogen, collectively referred to as the "contact activation pathway" or the "Kallikrein-Kinin System." Prekallikrein and high-molecular-weight kininogen circulate as a bi-molecular complex. The contact activation pathway is initiated on binding of F12 to negatively charged surfaces (or macromolecules) which induces a conformational change in F12 resulting in active F12 (F12a). F12a cleaves prekallikrein to generate active kallikrein, which in turn reciprocally activates F12. The active kallikrein then digests high-molecular-weight kininogen to liberate bradykinin.

Typically, C1INH inhibits the autoactivation of F12, the ability of F12a to activate prekallilrein, the activation of high molecular weight kininogen by kallikrein, and the feedback activation of F12 by kallikrein. Consequently, mutations causing C1INH deficiency or F12 gain-of-function result in excess production of bradykinin and onset of HAE angioedema.

Currently, HAE may be treated with 17α-alkylated androgens prophylactically to reduce to probability of recurrent episodes, or with disease-specific therapeutics to treat acute attacks. About 70% of individuals with HAE are treated with androgens or remain untreated, and about 30% receive therapeutics. However, androgens are unsuitable for short-term treatment of acute attacks because they take several days to become effective, and they can have significant side effects and may affect growth and development adversely. As a result, androgens are used only for long-term prophylaxis and are typically not administered to pregnant women or children. Furthermore, current therapeutics used to treat acute attacks must be administered intravenously numerous times per week or may cause side-effects that require drug administration and subsequent patient monitoring in a hospital, thereby limiting their regular prophylactic use to manage the disease long-term.

Therefore, in the absence of regimens which be administered safely, effectively and by more convenient routes and regimens to treat acute angioedema attacks and prophylactically manage recurrent attacks in a large proportion of patients, including pregnant women and children, there is a need for alternative therapies for subjects suffering from HAE.

SUMMARY OF THE INVENTION

The present invention provides iRNA compositions which effect the RNA-induced silencing complex (RISC)-mediated cleavage of RNA transcripts of a gene encoding Factor XII (F12). The F12 gene may be within a cell, e.g., a cell within a subject, such as a human subject. The present invention also provides methods of using the iRNA compositions of the invention for inhibiting the expression of an F12 gene and/or for treating a subject who would benefit from inhibiting or reducing the expression of an F12 gene, e.g., a subject suffering or prone to suffering from an F12-associated disorder, e.g., heredity angioedema (HAE) (such as hereditary angioedema type I; hereditary angioedema type II; hereditary angioedema type III; or any other hereditary angioedema caused by elevated levels of bradykinin); prekallikrein deficiency, hypertension, e.g., malignant essential hypertension, end stage renal disease, Fletcher Factor Deficiency, thromboembolic disease, inflammatory disease, or Alzheimer's Disease.

Accordingly, in an aspect, the invention provides a double stranded ribonucleic acid (dsRNA) agent for inhibiting expression of Factor XII (F12) in a cell, wherein the dsRNA agent comprises a sense strand and an antisense strand forming a double stranded region, wherein the sense strand comprises at least 15, e.g., 15, 16, 17, 18, 19, 20, or 21, contiguous nucleotides differing by no more than 0, 1, 2, or 3 nucleotides from the nucleotide sequence of SEQ ID NO:1 and the antisense strand comprises at least 15, e.g., 15, 16, 17, 18, 19, 20, 21, 22, or 23, contiguous nucleotides differing by no more than 1, 2, or 3 nucleotides from the corresponding portion of the nucleotide sequence of SEQ ID NO:2.

In another aspect, the present invention provides a double stranded ribonucleic acid (dsRNA) for inhibiting expression of Factor XII (F12) in a cell, wherein said dsRNA comprises a sense strand and an antisense strand forming a double stranded region, wherein the antisense strand comprises a region of complementarity to an mRNA encoding F12, and wherein the region of complementarity comprises at least 15, e.g., 15, 16, 17, 18, 19, 20, 21, 22, or 23, contiguous nucleotides differing by no more than 0, 1, 2, or 3 nucleotides from any one of the antisense nucleotide sequences in any one of Tables 2-3.

In one embodiment, the dsRNA agent comprises a sense strand comprising a contiguous nucleotide sequence which has at least 85%, e.g., 85%, 90%, 91%, 92%, 93%, 94%, 95%, 96%, 97%, 98%, 99%, or 100%, nucleotide sequence identity over its entire length to any one of the nucleotide sequences of the sense strands in any one of Tables 2-3 and an antisense strand comprising a contiguous nucleotide sequence which has at least 85%, e.g., 85%, 90%, 91%, 92%, 93%, 94%, 95%, 96%, 97%, 98%, 99%, or 100%, nucleotide sequence identity over its entire length to any one of the nucleotide sequences of the antisense strands in any one of Tables 2-3.

In one embodiment, the dsRNA agent comprises a sense strand comprising at least 15, e.g., 15, 16, 17, 18, 19, 20, or 21, contiguous nucleotides differing by no more than three nucleotides from any one of the nucleotide sequences of the sense strands in any one of Tables 2-3 and an antisense strand comprising at least 15, e.g., 15, 16, 17, 18, 19, 20, 21, 22, or 23, contiguous nucleotides differing by no more than three nucleotides from any one of the nucleotide sequences of the antisense strands in any one of Tables 2-3.

In another embodiment, the dsRNA agent comprises a sense strand comprising at least 15, e.g., 15, 16, 17, 18, 19, 20, or 21, contiguous nucleotides differing by no more than two nucleotides from any one of the nucleotide sequences of the sense strands in any one of Tables 2-3 and an antisense strand comprising at least 15, e.g., 15, 16, 17, 18, 19, 20, 21, 22, or 23, contiguous nucleotides differing by no more than two nucleotides from any one of the nucleotide sequences of the antisense strands in any one of Tables 2-3.

In another embodiment, the dsRNA agent comprises a sense strand comprising at least 15, e.g., 15, 16, 17, 18, 19, 20, or 21, contiguous nucleotides differing by no more than one nucleotide from any one of the nucleotide sequences of the sense strands in any one of Tables 2-3 and an antisense strand comprising at least 15, e.g., 15, 16, 17, 18, 19, 20, 21, 22, or 23, contiguous nucleotides differing by no more than one nucleotide from any one of the nucleotide sequences of the antisense strands in any one of Tables 2-3.

In another embodiment, the dsRNA agent comprises a sense strand comprising a nucleotide sequence selected from the group consisting of any one of the nucleotide sequences of the sense strands in any one of Tables 2-3 and an antisense strand comprising a nucleotide sequence selected from the group consisting of any one of the nucleotide sequences of the antisense strands in any one of Tables 2-3.

In one aspect, the present invention provides a double stranded ribonucleic acid (dsRNA) agent for inhibiting expression of Factor XII (F12) in a cell, wherein said dsRNA comprises a sense strand and an antisense strand forming a double stranded region, wherein the sense strand comprises at least 15, e.g., 15, 16, 17, 18, 19, 20, or 21, contiguous nucleotides differing by no more than 0, 1, 2, or 3 nucleotides from any one of the nucleotide sequence of nucleotides 75-97, 76-98, 79-101, 115-137, 117-139, 123-145, 132-154, 135-157, 137-159, 144-166, 201-223, or 1462-1484 of SEQ ID NO: 1, and the antisense strand comprises at least 15, e.g., 15, 16, 17, 18, 19, 20, 21, 22, or 23, contiguous nucleotides differing by no more than 0, 1, 2, or 3 nucleotides from the corresponding nucleotide sequence of SEQ ID NO:2.

In one embodiment, the sense strand comprises at least 15, e.g., 15, 16, 17, 18, 19, 20, or 21, contiguous nucleotides differing by no more than 0, 1, 2, or 3 nucleotides from any one of the nucleotide sequence of nucleotides 135-157, 144-166, or 201-223 of SEQ ID NO: 1, and the antisense strand comprises at least 15, e.g., 15, 16, 17, 18, 19, 20, 21, 22, or 23, contiguous nucleotides differing by no more than 0, 1, 2, or 3 nucleotides from the corresponding nucleotide sequence of SEQ ID NO:2.

In one embodiment, the antisense strand comprises at least 15, e.g., 15, 16, 17, 18, 19, 20, 21, 22, or 23, contiguous nucleotides differing by no more than 0, 1, 2, or 3 nucleotides from any one of the antisense strand nucleotide sequences of a duplex selected from the group consisting of AD-1534528, AD-1534479, AD-1534582, AD-1534611, AD-1534506, AD-1631309, AD-1534471, AD-1534555, AD-1534678, AD-1534585, AD-1534502, and AD-1534491.

In one embodiment, the antisense strand comprises at least 15, e.g., 15, 16, 17, 18, 19, 20, 21, 22, or 23, contiguous nucleotides differing by no more than 0, 1, 2, or 3 nucleotides from any one of the antisense strand nucleotide sequences of a duplex selected from the group consisting of AD-1534528, AD-1534479, and AD-1534582.

In one embodiment, the sense strand comprises at least 15, e.g., 15, 16, 17, 18, 19, 20, or 21, contiguous nucleotides differing by no more than three nucleotides from any one of the sense strand nucleotide sequences of a duplex selected from the group consisting of AD-1534528, AD-1534479, and AD-1534582 and the antisense strand comprises at least 15, e.g., 15, 16, 17, 18, 19, 20, 21, 22, or 23, contiguous nucleotides differing by no more than three nucleotides from any one of the antisense strand nucleotide sequences of a duplex selected from the group consisting of AD-1534528, AD-1534479, and AD-1534582.

In one embodiment, the sense strand comprises at least 15, e.g., 15, 16, 17, 18, 19, 20, or 21, contiguous nucleotides differing by no more than two nucleotides from any one of the sense strand nucleotide sequences of a duplex selected from the group consisting of AD-1534528, AD-1534479, and AD-1534582 and the antisense strand comprises at least 15, e.g., 15, 16, 17, 18, 19, 20, 21, 22, or 23, contiguous nucleotides differing by no more than two nucleotides from any one of the antisense strand nucleotide sequences of a duplex selected from the group consisting of AD-1534528, AD-1534479, and AD-1534582.

In one embodiment, the sense strand comprises at least 15, e.g., 15, 16, 17, 18, 19, 20, or 21, contiguous nucleotides differing by no more than one nucleotide from any one of the sense strand nucleotide sequences of a duplex selected from the group consisting of AD-1534528, AD-1534479, and AD-1534582 and the antisense strand comprises at least 15, e.g., 15, 16, 17, 18, 19, 20, 21, 22, or 23, contiguous nucleotides differing by no more than one nucleotide from any one of the antisense strand nucleotide sequences of a duplex selected from the group consisting of AD-1534528, AD-1534479, and AD-1534582.

In one embodiment, the sense strand comprises any one of the sense strand nucleotide sequences of a duplex selected from the group consisting of AD-1534528, AD-1534479, and AD-1534582 and the antisense strand comprises any one of the antisense strand nucleotide sequences of a duplex selected from the group consisting of AD-1534528, AD-1534479, and AD-1534582.

In one embodiment, the dsRNA agent comprises at least one modified nucleotide.

In one embodiment, substantially all of the nucleotides of the sense strand are modified nucleotides; substantially all of the nucleotides of the antisense strand are modified nucleotides; or substantially all of the nucleotides of the sense strand and substantially all of the nucleotides of the antisense strand are modified nucleotides.

In one embodiment, all of the nucleotides of the sense strand are modified nucleotides; all of the nucleotides of the antisense strand are modified nucleotides; or all of the nucleotides of the sense strand and all of the nucleotides of the antisense strand are modified nucleotides.

In one embodiment, at least one of the modified nucleotides is selected from the group consisting of a deoxynucleotide, a 3'-terminal deoxythimidine (dT) nucleotide, a 2'-O-methyl modified nucleotide, a 2'-fluoro modified nucleotide, a 2'-deoxy-modified nucleotide, a 2'-5'-linked ribonucleotide (3'-RNA), a locked nucleotide, an unlocked nucleotide, a conformationally restricted nucleotide, a constrained ethyl nucleotide, an abasic nucleotide, a 2'-amino-modified nucleotide, a 2'-O-allyl-modified nucleotide, 2'-C-alkyl-modified nucleotide, 2'-hydroxly-modified nucleotide, a 2'-methoxyethyl modified nucleotide, a 2'-O-alkyl-modified nucleotide, a morpholino nucleotide, a phosphoramidate, a non-natural base comprising nucleotide, a tetrahydropyran modified nucleotide, a 1,5-anhydrohexitol modified nucleotide, a cyclohexenyl modified nucleotide, a nucleotide comprising a phosphorothioate group, a nucleotide comprising a methylphosphonate group, a vinyl phosphonate nucleotide, a nucleotide comprising a 5'-phosphate, a nucleotide comprising a 5'-phosphate mimic, a thermally destabilizing nucleotide, a glycol modified nucleotide (GNA), a glycol nucleic acid S-Isomer (S-GNA), a nucleotide comprising a 2' phosphate, and a 2-O—(N-methylacetamide) modified nucleotide; and combinations thereof.

In one embodiment, at least one of the modified nucleotides is selected from the group consisting of LNA, HNA, CeNA, 2'-methoxyethyl, 2'-O-alkyl, 2'-O-allyl, 2'-C-allyl, 2'-fluoro, 2'-deoxy, 2'-hydroxyl, and glycol; and combinations thereof.

In one embodiment, at least one of the modified nucleotides is selected from the group consisting of a deoxynucleotide, a 2'-O-methyl modified nucleotide, a 2'-fluoro modified nucleotide, a 2'-deoxy-modified nucleotide, a glycol modified nucleotide (GNA), e.g., Ggn, Cgn, Tgn, or Agn, a nucleotide with a 2' phosphate, e.g., G2p, C2p, Alp or U2p, and a nucleotide comprising a phosphorothioate group, and combinations thereof.

In another embodiment, at least one of the modified nucleotides is a nucleotide with a thermally destabilizing nucleotide modification.

In one embodiment, the thermally destabilizing nucleotide modification is selected from the group consisting of an abasic modification; a mismatch with the opposing nucleotide in the duplex; a destabilizing sugar modification, a 2'-deoxy modification, an acyclic nucleotide, an unlocked nucleic acid (UNA), a glycerol nucleic acid (GNA); and 2'-5'-linked ribonucleotides ("3'-RNA").

In some embodiments, the modified nucleotide comprises a short sequence of 3'-terminal deoxythimidine nucleotides (dT).

In some embodiments, the dsRNA agent further comprises at least one phosphorothioate internucleotide linkage. In some embodiments, the dsRNA agent comprises 6-8 phosphorothioate internucleotide linkages. In one embodiment, the phosphorothioate or methylphosphonate internucleotide linkage is at the 3'-terminus of one strand. Optionally, the strand is the antisense strand. In another embodiment, the strand is the sense strand. In a related embodiment, the phosphorothioate or methylphosphonate internucleotide linkage is at the 5'-terminus of one strand. Optionally, the strand is the antisense strand. In another embodiment, the strand is the sense strand.

In another embodiment, the phosphorothioate or methylphosphonate internucleotide linkage is at the both the 5'- and 3'-terminus of one strand. Optionally, the strand is the antisense strand. In another embodiment, the strand is the sense strand.

The double stranded region may be 19-30 nucleotide pairs in length; 19-25 nucleotide pairs in length; 19-23 nucleotide pairs in length; 23-27 nucleotide pairs in length; or 21-23 nucleotide pairs in length.

In one embodiment, each strand is independently no more than 30 nucleotides in length.

In one embodiment, the sense strand is 21 nucleotides in length and the antisense strand is 23 nucleotides in length.

The region of complementarity may be at least 17 nucleotides in length; between 19 and 23 nucleotides in length; or 19 nucleotides in length.

In one embodiment, at least one strand comprises a 3' overhang of at least 1 nucleotide. In another embodiment, at least one strand comprises a 3' overhang of at least 2 nucleotides.

In one embodiment, the dsRNA agent further comprises a ligand.

In one embodiment, the ligand is conjugated to the 3' end of the sense strand of the dsRNA agent.

In one embodiment, the ligand is an N-acetylgalactosamine (GalNAc) derivative.

In one embodiment, the ligand is one or more GalNAc derivatives attached through a monovalent, bivalent, or trivalent branched linker.

In one embodiment, the ligand is

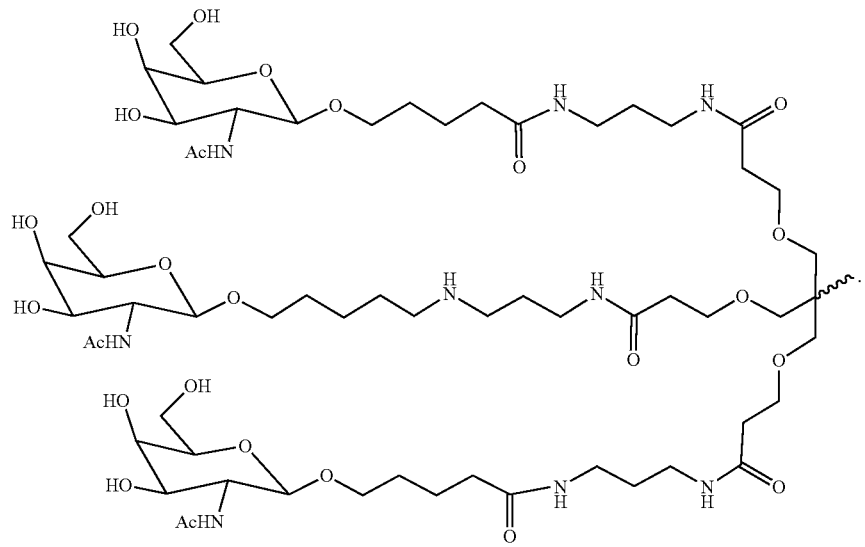 [SMILES: CC(=O)NC1C(OCCCCCNCCCNC(=O)CCOCC(C)(COCCC(=O)NCCCNC(=O)CCCCOC2OC(CO)C(O)C(O)C2NC(C)=O)COCCC(=O)NCCCNC(=O)CCCCOC2OC(CO)C(O)C(O)C2NC(C)=O)OC(CO)C(O)C1O]

In one embodiment, the dsRNA agent is conjugated to the ligand as shown in the following schematic

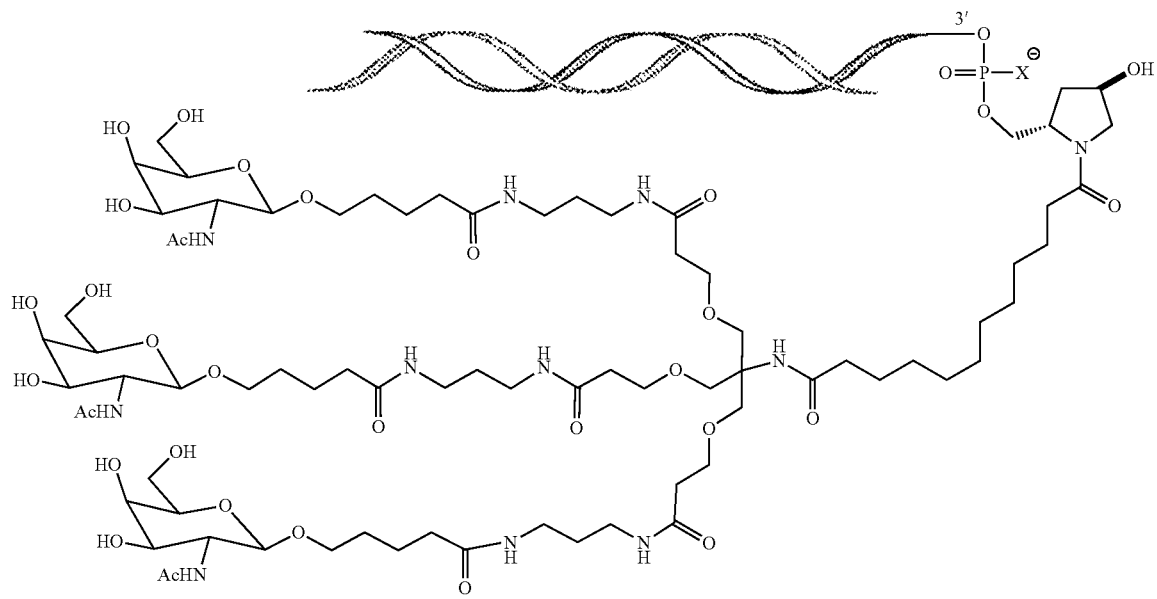

and, wherein X is O or S.

In one embodiment, the X is O.

In one embodiment, the dsRNA agent further comprises at least one phosphorothioate or methylphosphonate internucleotide linkage.

In one embodiment, the phosphorothioate or methylphosphonate internucleotide linkage is at the 3'-terminus of one strand, e.g., the antisense strand or the sense strand.

In another embodiment, the phosphorothioate or methylphosphonate internucleotide linkage is at the 5'-terminus of one strand, e.g., the antisense strand or the sense strand.

In one embodiment, the phosphorothioate or methylphosphonate internucleotide linkage is at the both the 5'- and 3'-terminus of one strand. In one embodiment, the strand is the antisense strand.

In one embodiment, the base pair at the 1 position of the 5'-end of the antisense strand of the duplex is an AU base pair.

The present invention also provides cells containing any of the dsRNA agents of the invention and pharmaceutical compositions comprising any of the dsRNA agents of the invention.

The pharmaceutical composition of the invention may include dsRNA agent in an unbuffered solution, e.g., saline or water, or the pharmaceutical composition of the invention may include the dsRNA agent is in a buffer solution, e.g., a buffer solution comprising acetate, citrate, prolamine, carbonate, or phosphate or any combination thereof; or phosphate buffered saline (PBS).

In one aspect, the present invention provides a method of inhibiting expression of a Factor XII (F12) gene in a cell. The method includes contacting the cell with any of the dsRNAs of the invention or any of the pharmaceutical compositions of the invention, thereby inhibiting expression of the F12 gene in the cell.

In one embodiment, the cell is within a subject, e.g., a human subject, e.g., a subject having a Factor XII (F12)-associated disorder, such as heredity angioedema (HAE) (e.g., hereditary angioedema type I; hereditary angioedema type II; hereditary angioedema type III; or any other hereditary angioedema caused by elevated levels of bradykinin); prekallikrein deficiency, hypertension, e.g., malignant essential hypertension, end stage renal disease, Fletcher Factor Deficiency, thromboembolic disease, inflammatory disease, or Alzheimer's Disease.

In certain embodiments, the F12 expression is inhibited by at least about 30%, 40%, 50%, 60%, 70%, 80%, 90%, or 95%. In one embodiment, inhibiting expression of F12 decreases F12 protein level in serum of the subject by at least 30%, 40%, 50%, 60%, 70%, 80%, 90%, or 95%.

In one aspect, the present invention provides a method of treating a subject having a disorder that would benefit from reduction in Factor XII (F12) expression. The method includes administering to the subject a therapeutically effective amount of any of the dsRNAs of the invention or any of the pharmaceutical compositions of the invention, thereby treating the subject having the disorder that would benefit from reduction in F12 expression.

In another aspect, the present invention provides a method of preventing at least one symptom in a subject having a disorder that would benefit from reduction in Factor XII (F12) expression. The method includes administering to the subject a prophylactically effective amount of any of the dsRNAs of the invention or any of the pharmaceutical compositions of the invention, thereby preventing at least one symptom in the subject having the disorder that would benefit from reduction in F12 expression.

In certain embodiments, the disorder is a Factor XII (F12)-associated disorder.

In some embodiments, the F12-associated disorder is selected from the group consisting of heredity angioedema (HAE) (such as hereditary angioedema type I; hereditary angioedema type II; hereditary angioedema type III; or any other hereditary angioedema caused by elevated levels of bradykinin); prekallikrein deficiency, hypertension, e.g., malignant essential hypertension, end stage renal disease, Fletcher Factor Deficiency, thromboembolic disease, inflammatory disease, and Alzheimer's Disease.

In some embodiments, the F12-associated disorder is HAE.

In other embodiments, the F12-associated disorder is prekallikrein deficiency.

In other embodiments, the F12-associated disorder is hypertension, e.g., malignant essential hypertension.

In other embodiments, the F12-associated disorder is end stage renal disease.

In other embodiments, the F12-associated disorder is Fletcher Factor Deficiency.

In another embodiment, an F12-associated disorder is thromboembolic disease.

In another embodiment, an F12-associated disorder is inflammatory disease.

In another embodiment, an F12-associated disorder is Alzheimer's Disease.

In certain embodiments, administration of the dsRNA agent to the subject causes a decrease F12 protein accumulation in the subject.

In certain embodiments, administration of the dsRNA agent to the subject causes a decrease in one or more of elevated bradykinin, prekallikrein deficiency, malignant essential hypertension, hypertension, end stage renal disease, Fletcher Factor Deficiency, inflammation, thrombosis, edema swelling of the extremities, face, larynx, upper respiratory tract, abdomen, trunk, genitals, or prodrome; laryngeal swelling; nonpruritic rash; nausea; vomiting; or abdominal pain.

In a further aspect, the present invention also provides methods of inhibiting the expression of F12 in a subject. The methods include administering to the subject a therapeutically effective amount of any of the dsRNAs provided herein, thereby inhibiting the expression of F12 in the subject.

In one embodiment, the subject is human.

In one embodiment, administration of the dsRNA agent to the subject causes a decrease in F12 protein accumulation in the subject.

In one embodiment, the dsRNA agent is administered to the subject at a dose of about 0.01 mg/kg to about 50 mg/kg.

In one embodiment, the dsRNA agent is administered to the subject subcutaneously.

In one embodiment, the methods of the invention further include determining the level of F12 in a sample(s) from the subject.

In one embodiment, the level of F12 in the subject sample(s) is an F12 protein level in a blood or serum or liver tissue sample(s).

In some embodiments, the methods of the invention further include determining the level of bradykinin; prekallikrein, or blood pressure in the subject.

In certain embodiments, the methods of the invention further comprise administering to the subject an additional therapeutic agent.

In certain embodiments, the additional therapeutic agent is selected from the group consisting of an androgen, such as danazol or oxandrolone, Berinert®, Cinryze™, Rhuconest®, Ecallantide, Firazyr®, Kalbitor®, or a combination of any of the foregoing.

The present invention also provides kits comprising any of the dsRNAs of the invention or any of the pharmaceutical compositions of the invention, and optionally, instructions for use. In one embodiment, the invention provides a kit for performing a method of inhibiting expression of F12 gene in a cell by contacting a cell with a double stranded RNAi agent of the invention in an amount effective to inhibit expression of the F12 in the cell. The kit comprises an RNAi agent and instructions for use and, optionally, means for administering the RNAi agent to a subject.

The present invention also provides vials comprising the dsRNA agent of the invention or the pharmaceutical composition of the invention. The present invention further provides syringes comprising the dsRNA agent of the invention or the pharmaceutical composition of the invention.

The present invention further provides an RNA-induced silencing complex (RISC) comprising an antisense strand of any of the dsRNA agents of the invention.

In another embodiment, the RNAi agent is a pharmaceutically acceptable salt thereof. "Pharmaceutically acceptable salts" of each of RNAi agents herein include, but are not limited to, a sodium salt, a calcium salt, a lithium salt, a potassium salt, an ammonium salt, a magnesium salt, an mixtures thereof. One skilled in the art will appreciate that the RNAi agent, when provided as a polycationic salt having one cation per free acid group of the optionally modified phosophodiester backbone and/or any other acidic modifications (e.g., 5'-terminal phosphonate groups). For example, an oligonucleotide of "n" nucleotides in length contains n−1 optionally modified phosophodiesters, so that an oligonucleotide of 21 nt in length may be provided as a salt having up to 20 cations (e.g, 20 sodium cations). Similarly, an RNAi agents having a sense strand of 21 nt in length and an antisense strand of 23 nt in length may be provided as a salt having up to 42 cations (e.g, 42 sodium cations).

In the preceding example, where the RNAi agent also includes a 5'-terminal phosphate or a 5'-terminal vinylphosphonate group, the RNAi agent may be provided as a salt having up to 44 cations (e.g, 44 sodium cations).

DETAILED DESCRIPTION OF THE INVENTION

Figure 1:
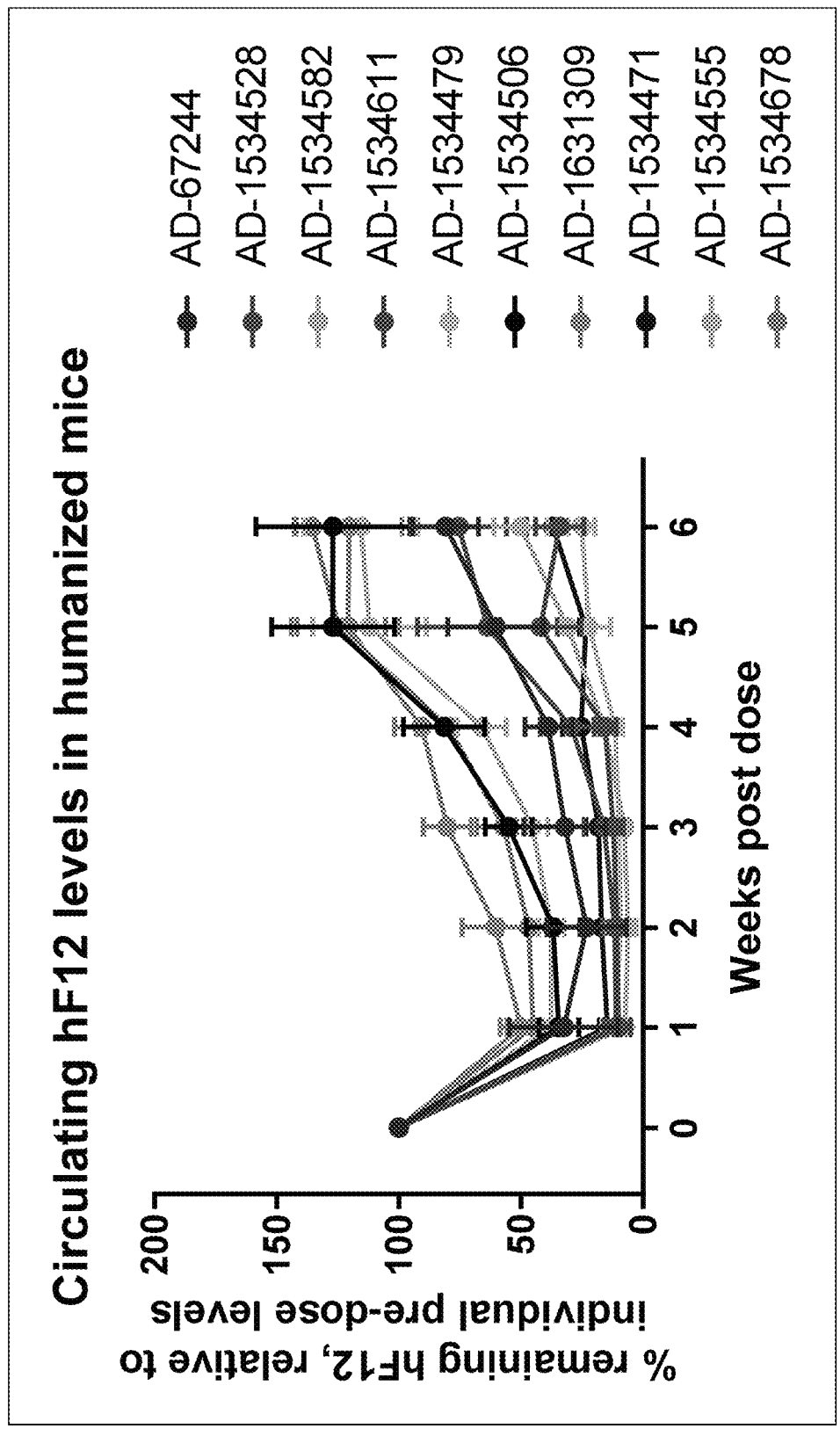
FIG. 1 is a graph depicting the percent of human Factor XII protein remaining in the serum of humanized Factor XII mice administered a single 0.2. g/kg dose of the indicated duplexes at weekly intervals post-dose. The percent of human Factor XII protein remaining is shown relative to individual pre=dose levels of human FactorXII.

The present invention provides iRNA compositions which effect the RNA-induced silencing complex (RISC)-mediated cleavage of RNA transcripts of a Factor XII (F12) gene. The gene may be within a cell, e.g., a cell within a subject, such as a human. The use of these iRNAs enables the targeted degradation of mRNAs of the corresponding gene (F12) in mammals.

The iRNAs of the invention have been designed to target the human Factor XII (F12) gene, including portions of the gene that are conserved in the F12 orthologs of other mammalian species. Without intending to be limited by theory, it is believed that a combination or sub-combination of the foregoing properties and the specific target sites or the specific modifications in these iRNAs confer to the iRNAs of the invention improved efficacy, stability, potency, durability, and safety.

Accordingly, the present invention provides methods for treating and preventing a Factor XII (F12)-associated disorder, e.g., heredity angioedema (HAE) (e.g., hereditary angioedema type I; hereditary angioedema type II; hereditary angioedema type III; or any other hereditary angioedema caused by elevated levels of bradykinin); prekallikrein deficiency, hypertension, e.g., malignant essential hypertension, end stage renal disease, Fletcher Factor Deficiency, thromboembolic disease, inflammatory disease, or Alzheimer's Disease using iRNA compositions which effect the RNA-induced silencing complex (RISC)-mediated cleavage of RNA transcripts of an F12 gene.

The iRNAs of the invention include an RNA strand (the antisense strand) having a region which is up to about 30 nucleotides or less in length, e.g., 19-30, 19-29, 19-28, 19-27, 19-26, 19-25, 19-24, 19-23, 19-22, 19-21, 19-20, 20-30, 20-29, 20-28, 20-27, 20-26, 20-25, 20-24,20-23, 20-22, 20-21, 21-30, 21-29, 21-28, 21-27, 21-26, 21-25, 21-24, 21-23, or 21-22 nucleotides in length, which region is substantially complementary to at least part of an mRNA transcript of an F12 gene.

In certain embodiments, one or both of the strands of the double stranded RNAi agents of the invention is up to 66 nucleotides in length, e.g., 36-66, 26-36, 25-36, 31-60, 22-43, 27-53 nucleotides in length, with a region of at least 19 contiguous nucleotides that is substantially complementary to at least a part of an mRNA transcript of an F12 gene. In some embodiments, such iRNA agents having longer length antisense strands may, for example, include a second RNA strand (the sense strand) of 20-60 nucleotides in length wherein the sense and antisense strands form a duplex of 18-30 contiguous nucleotides.

The use of iRNAs of the invention enables the targeted degradation of mRNAs of the corresponding gene (F12 gene) in mammals. Using in vitro assays, the present inventors have demonstrated that iRNAs targeting an F12 gene can potently mediate RNAi, resulting in significant inhibition of expression of an F12 gene. Thus, methods and compositions including these iRNAs are useful for treating a subject having an F12-associated disorder, e.g., heredity angioedema (HAE) (e.g., hereditary angioedema type I; hereditary angioedema type II; hereditary angioedema type III; or any other hereditary angioedema caused by elevated levels of bradykinin); prekallikrein deficiency, hypertension, e.g., malignant essential hypertension, end stage renal disease, Fletcher Factor Deficiency, thromboembolic disease, inflammatory disease, or Alzheimer's Disease.

Accordingly, the present invention provides methods and combination therapies for treating a subject having a disorder that would benefit from inhibiting or reducing the expression of an F12 gene, e.g., a Factor XII (F12)-associated disorder, such as heredity angioedema (HAE) (e.g., hereditary angioedema type I; hereditary angioedema type II; hereditary angioedema type III; or any other hereditary angioedema caused by elevated levels of bradykinin); prekallikrein deficiency, hypertension, e.g., malignant essential hypertension, end stage renal disease, Fletcher Factor Deficiency, thromboembolic disease, inflammatory disease, or Alzheimer's Disease using iRNA compositions which effect the RNA-induced silencing complex (RISC)-mediated cleavage of RNA transcripts of an F12 gene.

The present invention also provides methods for preventing at least one symptom in a subject having a disorder that would benefit from inhibiting or reducing the expression of an F12 gene, e.g., a Factor XII (F12)-associated disorder, such as heredity angioedema (HAE) (e.g., hereditary angioedema type I; hereditary angioedema type II; hereditary angioedema type III; or any other hereditary angioedema caused by elevated levels of bradykinin); prekallikrein deficiency, hypertension, e.g., malignant essential hypertension, end stage renal disease, Fletcher Factor Deficiency, thromboembolic disease, inflammatory disease, or Alzheimer's Disease.

The following detailed description discloses how to make and use compositions containing iRNAs to inhibit the expression of an F12 gene as well as compositions, uses, and methods for treating subjects that would benefit from inhibition and/or reduction of the expression of an F12 gene, e.g., subjects susceptible to or diagnosed with an F12-associated disorder.

I. Definitions

In order that the present invention may be more readily understood, certain terms are first defined. In addition, it should be noted that whenever a value or range of values of a parameter are recited, it is intended that values and ranges intermediate to the recited values are also intended to be part of this invention.

The articles "a" and "an" are used herein to refer to one or to more than one (i.e., to at least one) of the grammatical object of the article. By way of example, "an element" means one element or more than one element, e.g., a plurality of elements.

The term "including" is used herein to mean, and is used interchangeably with, the phrase "including but not limited to".

The term "or" is used herein to mean, and is used interchangeably with, the term "and/or," unless context clearly indicates otherwise. For example, "sense strand or antisense strand" is understood as "sense strand or antisense strand or sense strand and antisense strand."

The term "about" is used herein to mean within the typical ranges of tolerances in the art. For example, "about" can be understood as about 2 standard deviations from the mean. In certain embodiments, about means ±10%. In certain embodiments, about means ±5%. When about is present before a series of numbers or a range, it is understood that "about" can modify each of the numbers in the series or range.

The term "at least", "no less than", or "or more" prior to a number or series of numbers is understood to include the number adjacent to the term "at least", and all subsequent numbers or integers that could logically be included, as clear from context. For example, the number of nucleotides in a nucleic acid molecule must be an integer. For example, "at least 19 nucleotides of a 21 nucleotide nucleic acid molecule" means that 19, 20, or 21 nucleotides have the indicated property. When at least is present before a series of numbers or a range, it is understood that "at least" can modify each of the numbers in the series or range.

As used herein, "no more than" or "or less" is understood as the value adjacent to the phrase and logical lower values or integers, as logical from context, to zero. For example, a duplex with an overhang of "no more than 2 nucleotides" has a 2, 1, or 0 nucleotide overhang. When "no more than" is present before a series of numbers or a range, it is understood that "no more than" can modify each of the numbers in the series or range. As used herein, ranges include both the upper and lower limit.

As used herein, methods of detection can include determination that the amount of analyte present is below the level of detection of the method.

In the event of a conflict between an indicated target site and the nucleotide sequence for a sense or antisense strand, the indicated sequence takes precedence.

In the event of a conflict between a sequence and its indicated site on a transcript or other sequence, the nucleotide sequence recited in the specification takes precedence.

As used herein, "Factor XII (Hageman Factor)," used interchangeably with the terms "coagulation factor XII," "FXII," "F12," active F12," and "F12a," refers to the naturally occurring gene that encodes the zymogen form of F12a. F12 a is an enzyme (EC 3.4.21.38) of the serine protease (or serine endopeptidase) class that cleaves prekallikrein to form kallikrein, which subsequently releases bradykinin from high-molecular weight kininogen and activates F12.

The sequence of a human F12 mRNA transcript can be found at, for example, GenBank Accession No. GI: 1813757520 (NM_000505.4; SEQ ID NO:1; reverse complement, SEQ ID NO: 2). The sequence of mouse F12 mRNA can be found at, for example, GenBank Accession No. GI: 805299477 (NM_021489.3; SEQ ID NO:3; reverse complement, SEQ ID NO:4). The sequence of rat F12 mRNA can be found at, for example, GenBank Accession No. GI: 62078740 (NM_001014006.1; SEQ ID NO:5; reverse complement, SEQ ID NO: 6). The sequence of *Macaca fascicularis* F12 mRNA can be found at, for example, GenBank Accession No. GI: 982255999 (XM_015452310.1; SEQ ID NO:7; reverse complement, SEQ ID NO: 8). The sequence of *Macaca* mulatta F12 mRNA can be found at, for example, GenBank Accession No. GI: 1622948449 (XM_028849951.1; SEQ ID NO:9; reverse complement, SEQ ID NO:10).

Additional examples of F12 mRNA sequences are readily available through publicly available databases, e.g., GenBank, UniProt, OMIM, and the *Macaca* genome project web site.

Further information on F12 can be found, for example, at www.ncbi.nlm.nih.gov/gene/?term=F12.

The entire contents of each of the foregoing GenBank Accession numbers and the Gene database numbers are incorporated herein by reference as of the date of filing this application.

The term F12, as used herein, also refers to variations of the F12 gene including variants provided in the SNP database. Numerous sequence variations within the F12 gene have been identified and may be found at, for example, NCBI dbSNP and UniProt (see, e.g., www.ncbi.nlm.nih.gov/snp/?term=F12, the entire contents of which is incorporated herein by reference as of the date of filing this application.

As used herein, "target sequence" refers to a contiguous portion of the nucleotide sequence of an mRNA molecule formed during the transcription of an F12 gene, including mRNA that is a product of RNA processing of a primary transcription product. In one embodiment, the target portion of the sequence will be at least long enough to serve as a substrate for iRNA-directed cleavage at or near that portion of the nucleotide sequence of an mRNA molecule formed during the transcription of an F12gene.

The target sequence may be from about 19-36 nucleotides in length, e.g., about 19-30 nucleotides in length. For example, the target sequence can be about 19-30 nucleotides, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 nucleotides in length. In certain embodiments, the target sequence is 19-23 nucleotides in length, optionally 21-23 nucleotides in length. Ranges and lengths intermediate to the above recited ranges and lengths are also contemplated to be part of the disclosure.

As used herein, the term "strand comprising a sequence" refers to an oligonucleotide comprising a chain of nucleotides that is described by the sequence referred to using the standard nucleotide nomenclature.

"G," "C," "A," "T," and "U" each generally stand for a nucleotide that contains guanine, cytosine, adenine, thymidine, and uracil as a base, respectively. However, it will be understood that the term "ribonucleotide" or "nucleotide" can also refer to a modified nucleotide, as further detailed below, or a surrogate replacement moiety (see, e.g., Table 1). The skilled person is well aware that guanine, cytosine, adenine, and uracil can be replaced by other moieties without substantially altering the base pairing properties of an oligonucleotide comprising a nucleotide bearing such replacement moiety. For example, without limitation, a nucleotide comprising inosine as its base can base pair with nucleotides containing adenine, cytosine, or uracil. Hence, nucleotides containing uracil, guanine, or adenine can be replaced in the nucleotide sequences of dsRNA featured in the invention by a nucleotide containing, for example, inosine. In another example, adenine and cytosine anywhere in the oligonucleotide can be replaced with guanine and uracil, respectively to form G-U Wobble base pairing with the target mRNA. Sequences containing such replacement moieties are suitable for the compositions and methods featured in the invention.

The terms "iRNA", "RNAi agent," "iRNA agent,", "RNA interference agent" as used interchangeably herein, refer to an agent that contains RNA as that term is defined herein, and which mediates the targeted cleavage of an RNA transcript via an RNA-induced silencing complex (RISC) pathway. iRNA directs the sequence-specific degradation of mRNA through a process known as RNA interference (RNAi). The iRNA modulates, e.g., inhibits, the expression of an F12 gene in a cell, e.g., a liver cell within a subject, such as a mammalian subject.

In one embodiment, an RNAi agent of the invention includes a single stranded RNA that interacts with a target RNA sequence, e.g., an F12 target mRNA sequence, to direct the cleavage of the target RNA. Without wishing to be bound by theory it is believed that long double stranded RNA introduced into cells is broken down into siRNA by a Type III endonuclease known as Dicer (Sharp et al. (2001) Genes Dev. 15:485). Dicer, a ribonuclease-III-like enzyme, processes the dsRNA into 19-23 base pair short interfering RNAs with characteristic two base 3' overhangs (Bernstein, et al., (2001) Nature 409:363). The siRNAs are then incorporated into an RNA-induced silencing complex (RISC) where one or more helicases unwind the siRNA duplex, enabling the complementary antisense strand to guide target recognition (Nykanen, et al., (2001) Cell 107:309). Upon binding to the appropriate target mRNA, one or more endonucleases within the RISC cleave the target to induce silencing (Elbashir, et al., (2001) Genes Dev. 15:188). Thus, in one aspect the invention relates to a single stranded RNA (siRNA) generated within a cell and which promotes the formation of a RISC complex to effect silencing of the target gene, i.e., an F12 gene. Accordingly, the term "siRNA" is also used herein to refer to an iRNA as described above.

In certain embodiments, the RNAi agent may be a single-stranded siRNA (ssRNAi) that is introduced into a cell or organism to inhibit a target mRNA. Single-stranded RNAi agents bind to the RISC endonuclease, Argonaute 2, which then cleaves the target mRNA. The single-stranded siRNAs are generally 15-30 nucleotides and are chemically modified. The design and testing of single-stranded siRNAs are described in U.S. Pat. No. 8,101,348 and in Lima et al., (2012) Cell 150:883-894, the entire contents of each of which are hereby incorporated herein by reference. Any of the antisense nucleotide sequences described herein may be used as a single-stranded siRNA as described herein or as chemically modified by the methods described in Lima et al., (2012) Cell 150:883-894.

In certain embodiments, an "iRNA" for use in the compositions, uses, and methods of the invention is a double stranded RNA and is referred to herein as a "double stranded RNA agent," "double stranded RNA (dsRNA) molecule," "dsRNA agent," or "dsRNA". The term "dsRNA", refers to a complex of ribonucleic acid molecules, having a duplex structure comprising two anti-parallel and substantially complementary nucleic acid strands, referred to as having "sense" and "antisense" orientations with respect to a target RNA, i.e., an F12 gene. In some embodiments of the invention, a double stranded RNA (dsRNA) triggers the degradation of a target RNA, e.g., an mRNA, through a post-transcriptional gene-silencing mechanism referred to herein as RNA interference or RNAi.

In general, the majority of nucleotides of each strand of a dsRNA molecule are ribonucleotides, but as described in detail herein, each or both strands can also include one or more non-ribonucleotides, e.g., a deoxyribonucleotide or a modified nucleotide. In addition, as used in this specification, an "iRNA" may include ribonucleotides with chemical modifications; an iRNA may include substantial modifications at multiple nucleotides. As used herein, the term "modified nucleotide" refers to a nucleotide having, independently, a modified sugar moiety, a modified internucleotide linkage, or modified nucleobase, or any combination thereof. Thus, the term modified nucleotide encompasses substitutions, additions or removal of, e.g., a functional group or atom, to internucleoside linkages, sugar moieties, or nucleobases. The modifications suitable for use in the agents of the invention include all types of modifications disclosed herein or known in the art. Any such modifications, as used in a siRNA type molecule, are encompassed by "iRNA" or "RNAi agent" for the purposes of this specification and claims.

In certain embodiments of the instant disclosure, inclusion of a deoxy-nucleotide if present within an RNAi agent can be considered to constitute a modified nucleotide.

The duplex region may be of any length that permits specific degradation of a desired target RNA through a RISC pathway, and may range from about 19 to 36 base pairs in length, e.g., about 19-30 base pairs in length, for example, about 9, 10, 11, 12, 13, 14, 15, 16, 17, 18, 19, 20, 21, 22, 23, 24, 25, 26, 27, 28, 29, 30, 31, 32, 33, 34, 35, or 36 base pairs in length, such as about 19-30, 19-29, 19-28, 19-27, 19-26, 19-25, 19-24, 19-23, 19-22, 19-21, 19-20, 20-30, 20-29, 20-28, 20-27, 20-26, 20-25, 20-24,20-23, 20-22, 20-21, 21-30, 21-29, 21-28, 21-27, 21-26, 21-25, 21-24, 21-23, or 21-22 base pairs in length. In certain embodiments, the duplex region is 19-21 base pairs in length, e.g., 21 base pairs in length. Ranges and lengths intermediate to the above recited ranges and lengths are also contemplated to be part of the disclosure.

The two strands forming the duplex structure may be different portions of one larger RNA molecule, or they may be separate RNA molecules. Where the two strands are part of one larger molecule, and therefore are connected by an uninterrupted chain of nucleotides between the 3'-end of one strand and the 5'-end of the respective other strand forming the duplex structure, the connecting RNA chain is referred to as a "hairpin loop." A hairpin loop can comprise at least one unpaired nucleotide. In some embodiments, the hairpin loop can comprise at least 2, 3, 4, 5, 6, 7, 8, 9, 10, 20, 23 or more unpaired nucleotides. In some embodiments, the hairpin loop can be 10 or fewer nucleotides. In some embodiments, the hairpin loop can be 8 or fewer unpaired nucleotides. In some embodiments, the hairpin loop can be 4-10 unpaired nucleotides. In some embodiments, the hairpin loop can be 4-8 nucleotides.

Where the two substantially complementary strands of a dsRNA are comprised by separate RNA molecules, those molecules need not be, but can be covalently connected. Where the two strands are connected covalently by means other than an uninterrupted chain of nucleotides between the 3'-end of one strand and the 5'-end of the respective other strand forming the duplex structure, the connecting structure is referred to as a "linker." The RNA strands may have the same or a different number of nucleotides. The maximum number of base pairs is the number of nucleotides in the shortest strand of the dsRNA minus any overhangs that are present in the duplex. In addition to the duplex structure, an RNAi may comprise one or more nucleotide overhangs. In one embodiment of the RNAi agent, at least one strand comprises a 3' overhang of at least 1 nucleotide. In another embodiment, at least one strand comprises a 3' overhang of at least 2 nucleotides, e.g., 2, 3, 4, 5, 6, 7, 9, 10, 11, 12, 13, 14, or 15 nucleotides. In other embodiments, at least one strand of the RNAi agent comprises a 5' overhang of at least 1 nucleotide. In certain embodiments, at least one strand comprises a 5' overhang of at least 2 nucleotides, e.g., 2, 3, 4, 5, 6, 7, 9, 10, 11, 12, 13, 14, or 15 nucleotides. In still other embodiments, both the 3' and the 5' end of one strand of the RNAi agent comprise an overhang of at least 1 nucleotide.

In certain embodiments, an iRNA agent of the invention is a dsRNA, each strand of which comprises 19-23 nucleotides, that interacts with a target RNA sequence, e.g., an F12 gene, to direct cleavage of the target RNA.

In some embodiments, an iRNA of the invention is a dsRNA of 24-30 nucleotides that interacts with a target RNA sequence, e.g., an F12 target mRNA sequence, to direct the cleavage of the target RNA.

As used herein, the term "nucleotide overhang" refers to at least one unpaired nucleotide that protrudes from the duplex structure of a double stranded iRNA. For example, when a 3'-end of one strand of a dsRNA extends beyond the 5'-end of the other strand, or vice versa, there is a nucleotide overhang. A dsRNA can comprise an overhang of at least one nucleotide; alternatively the overhang can comprise at least two nucleotides, at least three nucleotides, at least four nucleotides, at least five nucleotides or more. A nucleotide overhang can comprise or consist of a nucleotide/nucleoside analog, including a deoxynucleotide/nucleoside. The overhang(s) can be on the sense strand, the antisense strand, or any combination thereof. Furthermore, the nucleotide(s) of an overhang can be present on the 5'-end, 3'-end, or both ends of either an antisense or sense strand of a dsRNA.

In one embodiment, the antisense strand of a dsRNA has a 1-10 nucleotide, e.g., a 1, 2, 3, 4, 5, 6, 7, 8, 9, or 10 nucleotide, overhang at the 3'-end or the 5'-end. In one embodiment, the sense strand of a dsRNA has a 1-10 nucleotide, e.g., a 1, 2, 3, 4, 5, 6, 7, 8, 9, or 10 nucleotide, overhang at the 3'-end or the 5'-end. In another embodiment, one or more of the nucleotides in the overhang is replaced with a nucleoside thiophosphate.

In certain embodiments, the antisense strand of a dsRNA has a 1-10 nucleotide, e.g., 0-3, 1-3, 2-4, 2-5, 4-10, 5-10, e.g., a 1, 2, 3, 4, 5, 6, 7, 8, 9, or 10 nucleotide, overhang at the 3'-end or the 5'-end. In one embodiment, the sense strand of a dsRNA has a 1-10 nucleotide, e.g., a 1, 2, 3, 4, 5, 6, 7, 8, 9, or 10 nucleotide, overhang at the 3'-end or the 5'-end. In another embodiment, one or more of the nucleotides in the overhang is replaced with a nucleoside thiophosphate.

In certain embodiments, the antisense strand of a dsRNA has a 1-10 nucleotides, e.g., a 1, 2, 3, 4, 5, 6, 7, 8, 9, or 10 nucleotide, overhang at the 3'-end or the 5'-end. In certain embodiments, the overhang on the sense strand or the antisense strand, or both, can include extended lengths longer than 10 nucleotides, e.g., 1-30 nucleotides, 2-30 nucleotides, 10-30 nucleotides, 10-25 nucleotides, 10-20 nucleotides, or 10-15 nucleotides in length. In certain embodiments, an extended overhang is on the sense strand of the duplex. In certain embodiments, an extended overhang is present on the 3' end of the sense strand of the duplex. In certain embodiments, an extended overhang is present on the 5' end of the sense strand of the duplex. In certain embodiments, an extended overhang is on the antisense strand of the duplex. In certain embodiments, an extended overhang is present on the 3'end of the antisense strand of the duplex. In certain embodiments, an extended overhang is present on the 5'end of the antisense strand of the duplex. In certain embodiments, one or more of the nucleotides in the extended overhang is replaced with a nucleoside thiophosphate. In certain embodiments, the overhang includes a self-complementary portion such that the overhang is capable of forming a hairpin structure that is stable under physiological conditions.

"Blunt" or "blunt end" means that there are no unpaired nucleotides at that end of the double stranded RNA agent, i.e., no nucleotide overhang. A "blunt ended" double stranded RNA agent is double stranded over its entire length, i.e., no nucleotide overhang at either end of the molecule. The RNAi agents of the invention include RNAi agents with no nucleotide overhang at one end (i.e., agents with one overhang and one blunt end) or with no nucleotide overhangs at either end. Most often such a molecule will be double-stranded over its entire length.

The term "antisense strand" or "guide strand" refers to the strand of an iRNA, e.g., a dsRNA, which includes a region that is substantially complementary to a target sequence, e.g., an F12 mRNA.

As used herein, the term "region of complementarity" refers to the region on the antisense strand that is substantially complementary to a sequence, for example a target sequence, e.g., an F12 nucleotide sequence, as defined herein. Where the region of complementarity is not fully complementary to the target sequence, the mismatches can be in the internal or terminal regions of the molecule. Generally, the most tolerated mismatches are in the terminal regions, e.g., within 5, 4, or 3 nucleotides of the 5'- or 3'-end of the iRNA. In some embodiments, a double stranded RNA agent of the invention includes a nucleotide mismatch in the antisense strand. In some embodiments, the antisense strand of the double stranded RNA agent of the invention includes no more than 4 mismatches with the target mRNA, e.g., the antisense strand includes 4, 3, 2, 1, or 0 mismatches with the target mRNA. In some embodiments, the antisense strand double stranded RNA agent of the invention includes no more than 4 mismatches with the sense strand, e.g., the antisense strand includes 4, 3, 2, 1, or 0 mismatches with the sense strand. In some embodiments, a double stranded RNA agent of the invention includes a nucleotide mismatch in the sense strand. In some embodiments, the sense strand of the double stranded RNA agent of the invention includes no more than 4 mismatches with the antisense strand, e.g., the sense strand includes 4, 3, 2, 1, or 0 mismatches with the antisense strand. In some embodiments, the nucleotide mismatch is, for example, within 5, 4, 3 nucleotides from the 3'-end of the iRNA. In another embodiment, the nucleotide mismatch is, for example, in the 3'-terminal nucleotide of the iRNA agent. In some embodiments, the mismatch(s) is not in the seed region.

Thus, an RNAi agent as described herein can contain one or more mismatches to the target sequence. In one embodiment, an RNAi agent as described herein contains no more than 3 mismatches (i.e., 3, 2, 1, or 0 mismatches). In one embodiment, an RNAi agent as described herein contains no more than 2 mismatches. In one embodiment, an RNAi agent as described herein contains no more than 1 mismatch.

In one embodiment, an RNAi agent as described herein contains 0 mismatches. In certain embodiments, if the antisense strand of the RNAi agent contains mismatches to the target sequence, the mismatch can optionally be restricted to be within the last 5 nucleotides from either the 5'- or 3'-end of the region of complementarity. For example, in such embodiments, for a 23 nucleotide RNAi agent, the strand which is complementary to a region of an F12 gene, generally does not contain any mismatch within the central 13 nucleotides. The methods described herein or methods known in the art can be used to determine whether an RNAi agent containing a mismatch to a target sequence is effective in inhibiting the expression of an F12 gene. Consideration of the efficacy of RNAi agents with mismatches in inhibiting expression of an F12 gene is important, especially if the particular region of complementarity in an F12 gene is known to have polymorphic sequence variation within the population.

The term "sense strand" or "passenger strand" as used herein, refers to the strand of an iRNA that includes a region that is substantially complementary to a region of the antisense strand as that term is defined herein.

As used herein, "substantially all of the nucleotides are modified" are largely but not wholly modified and can include not more than 5, 4, 3, 2, or 1 unmodified nucleotides.

As used herein, the term "cleavage region" refers to a region that is located immediately adjacent to the cleavage site. The cleavage site is the site on the target at which cleavage occurs. In some embodiments, the cleavage region comprises three bases on either end of, and immediately adjacent to, the cleavage site. In some embodiments, the cleavage region comprises two bases on either end of, and immediately adjacent to, the cleavage site. In some embodiments, the cleavage site specifically occurs at the site bound by nucleotides 10 and 11 of the antisense strand, and the cleavage region comprises nucleotides 11, 12 and 13.

As used herein, and unless otherwise indicated, the term "complementary," when used to describe a first nucleotide sequence in relation to a second nucleotide sequence, refers to the ability of an oligonucleotide or polynucleotide comprising the first nucleotide sequence to hybridize and form a duplex structure under certain conditions with an oligonucleotide or polynucleotide comprising the second nucleotide sequence, as will be understood by the skilled person. Such conditions can, for example, be stringent conditions, where stringent conditions can include: 400 mM NaCl, 40 mM PIPES pH 6.4, 1 mM EDTA, 50° C. or 70° C. for 12-16 hours followed by washing (see, e.g., "Molecular Cloning: A Laboratory Manual, Sambrook, et al. (1989) Cold Spring Harbor Laboratory Press). Other conditions, such as physiologically relevant conditions as can be encountered inside an organism, can apply. The skilled person will be able to determine the set of conditions most appropriate for a test of complementarity of two sequences in accordance with the ultimate application of the hybridized nucleotides.

Complementary sequences within an iRNA, e.g., within a dsRNA as described herein, include base-pairing of the oligonucleotide or polynucleotide comprising a first nucleotide sequence to an oligonucleotide or polynucleotide comprising a second nucleotide sequence over the entire length of one or both nucleotide sequences. Such sequences can be referred to as "fully complementary" with respect to each other herein. However, where a first sequence is referred to as "substantially complementary" with respect to a second sequence herein, the two sequences can be fully complementary, or they can form one or more, but generally not more than 5, 4, 3, or 2 mismatched base pairs upon hybridization for a duplex up to 30 base pairs, while retaining the ability to hybridize under the conditions most relevant to their ultimate application, e.g., inhibition of gene expression, in vitro or in vivo. However, where two oligonucleotides are designed to form, upon hybridization, one or more single stranded overhangs, such overhangs shall not be regarded as mismatches with regard to the determination of complementarity. For example, a dsRNA comprising one oligonucleotide 21 nucleotides in length and another oligonucleotide 23 nucleotides in length, wherein the longer oligonucleotide comprises a sequence of 21 nucleotides that is fully complementary to the shorter oligonucleotide, can yet be referred to as "fully complementary" for the purposes described herein.

"Complementary" sequences, as used herein, can also include, or be formed entirely from, non-Watson-Crick base pairs or base pairs formed from non-natural and modified nucleotides, in so far as the above requirements with respect to their ability to hybridize are fulfilled. Such non-Watson-Crick base pairs include, but are not limited to, G:U Wobble or Hoogsteen base pairing.

The terms "complementary," "fully complementary" and "substantially complementary" herein can be used with respect to the base matching between the sense strand and the antisense strand of a dsRNA, or between two oligonucleotides or polynucleotides, such as the antisense strand of a double stranded RNA agent and a target sequence, as will be understood from the context of their use.

As used herein, a polynucleotide that is "substantially complementary to at least part of" a messenger RNA (mRNA) refers to a polynucleotide that is substantially complementary to a contiguous portion of the mRNA of interest (e.g., an mRNA encoding an F12 gene). For example, a polynucleotide is complementary to at least a part of an F12 mRNA if the sequence is substantially complementary to a non-interrupted portion of an mRNA encoding an F12 gene.

Accordingly, in some embodiments, the antisense polynucleotides disclosed herein are fully complementary to the target F12 sequence. In other embodiments, the antisense polynucleotides disclosed herein are substantially complementary to the target F12 sequence and comprise a contiguous nucleotide sequence which is at least 80% complementary over its entire length to the equivalent region of the nucleotide sequence of any one of SEQ ID NOs:1, 3, 5, 7, or 9, or a fragment of any one of SEQ ID NOs:1, 3, 5, 7, or 9, such as about 85%, about 90%, about 91%, about 92%, about 93%, about 94%, about 95%, about 96%, about 97%, about 98%, or about 99% complementary. In other embodiments, the antisense polynucleotides disclosed herein are substantially complementary to the target F12 sequence and comprise a contiguous nucleotide sequence which is at least about 80% complementary over its entire length to any one of the sense strand nucleotide sequences in any one of any one of Tables 2-3, or a fragment of any one of the sense strand nucleotide sequences in any one of Tables 2-3, such as about 85%, about 90%, about 91%, about 92%, about 93%, about 94%, about 95%, about 96%, about 97%, about 98%, about 99%, or 100% complementary.

In some embodiments, the antisense polynucleotides disclosed herein are substantially complementary to a fragment of a target F12 sequence and comprise a contiguous nucleotide sequence which is at least 80% complementary over its entire length to a fragment of SEQ ID NO: 1 selected from the group of nucleotides 75-97, 76-98, 79-101, 115-137, 117-139, 123-145, 132-154, 135-157, 137-159, 144-166, 201-223, or 1462-1484 of SEQ ID NO: 1, such as about 85%, about 90%, about 91%, about 92%, about 93%, about 94%, about 95%, about 96%, about 97%, about 98%, or about 99% complementary.

In some embodiments, the antisense polynucleotides disclosed herein are substantially complementary to a fragment of a target F12 sequence and comprise a contiguous nucleotide sequence which is at least 80% complementary over its entire length to a fragment of SEQ ID NO: 1 selected from the group of nucleotides 135-157, 144-166, or 201-223 of SEQ ID NO: 1, such as about 85%, about 90%, about 91%, about 92%, about 93%, about 94%, about 95%, about 96%, about 97%, about 98%, or about 99% complementary.

In one embodiment, an RNAi agent of the disclosure includes a sense strand that is substantially complementary to an antisense polynucleotide which, in turn, is the same as a target F12 sequence, and wherein the sense strand polynucleotide comprises a contiguous nucleotide sequence which is at least about 80% complementary over its entire length to the equivalent region of the nucleotide sequence of SEQ ID NOs: 2, 4, 6, 8, or 10, or a fragment of any one of SEQ ID NOs:2, 4, 6, 8, or 10, such as about 85%, about 90%, about 91%, about 92%, about 93%, about 94%, about 95%, about 96%, about 97%, about 98%, about 99%, or 100% complementary.

In some embodiments, an iRNA of the invention includes a sense strand that is substantially complementary to an antisense polynucleotide which, in turn, is complementary to a target F12 sequence, and wherein the sense strand polynucleotide comprises a contiguous nucleotide sequence which is at least about 80% complementary over its entire length to any one of the antisense strand nucleotide sequences in any one of any one of Tables 2-3, or a fragment of any one of the antisense strand nucleotide sequences in any one of Tables 2-3, such as about 85%, about 90%, about 91%, about 92%, about 93%, about 94%, about 95%, about 96%, about 97%, about 98%, about 99%, or 100% complementary.

In certain embodiments, the sense and antisense strands are selected from any one of duplexes AD-1534528, AD-1534479, AD-1534582, AD-1534611, AD-1534506, AD-1631309, AD-1534471, AD-1534555, AD-1534678, AD-1534585, AD-1534502, and AD-1534491.

In certain embodiments, the sense and antisense strands are selected from any one of duplexes AD-1534528, AD-1534479, and AD-1534582.

In general, an "iRNA" includes ribonucleotides with chemical modifications. Such modifications may include all types of modifications disclosed herein or known in the art. Any such modifications, as used in a dsRNA molecule, are encompassed by "iRNA" for the purposes of this specification and claims.

In certain embodiments of the instant disclosure, inclusion of a deoxy-nucleotide if present within an RNAi agent can be considered to constitute a modified nucleotide.

In an aspect of the invention, an agent for use in the methods and compositions of the invention is a single-stranded antisense oligonucleotide molecule that inhibits a target mRNA via an antisense inhibition mechanism. The single-stranded antisense oligonucleotide molecule is complementary to a sequence within the target mRNA. The single-stranded antisense oligonucleotides can inhibit translation in a stoichiometric manner by base pairing to the mRNA and physically obstructing the translation machinery, see Dias, N. et al., (2002) *Mol Cancer Ther* 1:347-355. The single-stranded antisense oligonucleotide molecule may be about 14 to about 30 nucleotides in length and have a sequence that is complementary to a target sequence. For example, the single-stranded antisense oligonucleotide molecule may comprise a sequence that is at least about 14, 15, 16, 17, 18, 19, 20, or more contiguous nucleotides from any one of the antisense sequences described herein.

The phrase "contacting a cell with an iRNA," such as a dsRNA, as used herein, includes contacting a cell by any possible means. Contacting a cell with an iRNA includes contacting a cell in vitro with the iRNA or contacting a cell in vivo with the iRNA. The contacting may be done directly or indirectly. Thus, for example, the iRNA may be put into physical contact with the cell by the individual performing the method, or alternatively, the iRNA may be put into a situation that will permit or cause it to subsequently come into contact with the cell.

Contacting a cell in vitro may be done, for example, by incubating the cell with the iRNA. Contacting a cell in vivo may be done, for example, by injecting the iRNA into or near the tissue where the cell is located, or by injecting the iRNA into another area, e.g., the bloodstream or the subcutaneous space, such that the agent will subsequently reach the tissue where the cell to be contacted is located. For example, the iRNA may contain or be coupled to a ligand, e.g., GalNAc, that directs the iRNA to a site of interest, e.g., the liver. Combinations of in vitro and in vivo methods of contacting are also possible. For example, a cell may also be contacted in vitro with an iRNA and subsequently transplanted into a subject.

In certain embodiments, contacting a cell with an iRNA includes "introducing" or "delivering the iRNA into the cell" by facilitating or effecting uptake or absorption into the cell. Absorption or uptake of an iRNA can occur through unaided diffusion or active cellular processes, or by auxiliary agents or devices. Introducing an iRNA into a cell may be in vitro or in vivo. For example, for in vivo introduction, iRNA can be injected into a tissue site or administered systemically. In vitro introduction into a cell includes methods known in the art such as electroporation and lipofection. Further approaches are described herein below or are known in the art.

The term "lipid nanoparticle" or "LNP" is a vesicle comprising a lipid layer encapsulating a pharmaceutically active molecule, such as a nucleic acid molecule, e.g., an iRNA or a plasmid from which an iRNA is transcribed. LNPs are described in, for example, U.S. Pat. Nos. 6,858, 225, 6,815,432, 8,158,601, and 8,058,069, the entire contents of which are hereby incorporated herein by reference.

As used herein, a "subject" is an animal, such as a mammal, including a primate (such as a human, a non-human primate, e.g., a monkey, and a chimpanzee), a non-primate (such as a cow, a pig, a horse, a goat, a rabbit, a sheep, a hamster, a guinea pig, a cat, a dog, a rat, or a mouse), or a bird that expresses the target gene, either endogenously or heterologously. In an embodiment, the subject is a human, such as a human being treated or assessed for a disease or disorder that would benefit from reduction in F12 expression; a human at risk for a disease or disorder that would benefit from reduction in F12 expression; a human having a disease or disorder that would benefit from reduction in F12 expression; or human being treated for a disease or disorder that would benefit from reduction in F12 expression as described herein. In some embodiments, the subject is a female human. In other embodiments, the subject is a male human. In one embodiment, the subject is an adult subject. In another embodiment, the subject is a pediatric subject.

As used herein, the terms "treating" or "treatment" refer to a beneficial or desired result, such as reducing at least one sign or symptom of an F12-associated disorder in a subject. Treatment also includes a reduction of one or more sign or symptoms associated with unwanted F12 expression; diminishing the extent of unwanted F12 activation or stabilization; amelioration or palliation of unwanted F12 activation or stabilization. "Treatment" can also mean prolonging survival as compared to expected survival in the absence of treatment.

The term "lower" in the context of the level of F12 in a subject or a disease marker or symptom refers to a statistically significant decrease in such level. The decrease can be, for example, at least 10%, 15%, 20%, 25%, 30%, %, 40%, 45%, 50%, 55%, 60%, 65%, 70%, 75%, 80%, 85%, 90%, 95%, or more. In certain embodiments, a decrease is at least 20%. In certain embodiments, the decrease is at least 50% in a disease marker, e.g., protein or gene expression level. "Lower" in the context of the level of F12 in a subject is a decrease to a level accepted as within the range of normal for an individual without such disorder. In certain embodiments, "lower" is the decrease in the difference between the level of a marker or symptom for a subject suffering from a disease and a level accepted within the range of normal for an individual. The term "lower" can also be used in association with normalizing a symptom of a disease or condition, i.e. decreasing the difference between a level in a subject suffering from an F12-associated disorder towards or to a level in a normal subject not suffering from an F12-associated disorder. As used herein, if a disease is associated with an elevated value for a symptom, "normal" is considered to be the upper limit of normal. If a disease is associated with a decreased value for a symptom, "normal" is considered to be the lower limit of normal.

As used herein, "prevention" or "preventing," when used in reference to a disease, disorder or condition thereof, may be treated or ameliorated by a reduction in expression of an F12 gene, refers to a reduction in the likelihood that a subject will develop a symptom associated with such a disease, disorder, or condition, e.g., a symptom of an F12-associated disorder, e.g., heredity angioedema (HAE) (e.g., hereditary angioedema type I; hereditary angioedema type II; hereditary angioedema type III; or any other hereditary angioedema caused by elevated levels of bradykinin); prekallikrein deficiency, hypertension, e.g., malignant essential hypertension, end stage renal disease, Fletcher Factor Deficiency, thromboembolic disease, inflammatory disease, or Alzheimer's Disease. The failure to develop a disease, disorder or condition, or the reduction in the development of a symptom associated with such a disease, disorder or condition (e.g., by at least about 10% on a clinically accepted scale for that disease or disorder), or the exhibition of delayed symptoms delayed (e.g., by days, weeks, months or years) is considered effective prevention.

As used herein, the term "Factor XII-associated disorder" or "F12-associated disorder," is a disease or disorder that is caused by, or associated with, F12 gene expression or F12 protein production. The term "F12-associated disorder" includes a disease, disorder or condition that would benefit from a decrease in F12 gene expression, replication, or protein activity. In some embodiments, the F12-associated disorder is selected from the group consisting of heredity angioedema (HAE) (e.g., hereditary angioedema type I; hereditary angioedema type II; hereditary angioedema type III; or any other hereditary angioedema caused by elevated levels of bradykinin); prekallikrein deficiency, hypertension, e.g., malignant essential hypertension, end stage renal disease, Fletcher Factor Deficiency, thromboembolic disease, inflammatory disease, and Alzheimer's Disease.

In one embodiment, an F12-associated disorder is HAE. In another embodiment, an F12-associated disorder is prekallikrein deficiency. In another embodiment, an F12-associated disorder is hypertension, e.g., malignant essential hypertension. In another embodiment, an F12-associated disorder is end stage renal disease. In another embodiment, an F12-associated disorder is Fletcher Factor deficiency. In another embodiment, an F12-associated disorder is thromboembolic disease. In another embodiment, an F12-associated disorder is inflammatory disease. In another embodiment, an F12-associated disorder is Alzheimer's Disease.

"Therapeutically effective amount," as used herein, is intended to include the amount of an RNAi agent that, when administered to a subject having an F12-associated disorder, is sufficient to effect treatment of the disease (e.g., by diminishing, ameliorating, or maintaining the existing disease or one or more symptoms of disease). The "therapeutically effective amount" may vary depending on the RNAi agent, how the agent is administered, the disease and its severity and the history, age, weight, family history, genetic makeup, the types of preceding or concomitant treatments, if any, and other individual characteristics of the subject to be treated.

"Prophylactically effective amount," as used herein, is intended to include the amount of an RNAi agent that, when administered to a subject having an F12-associated disorder, is sufficient to prevent or ameliorate the disorder or one or more symptoms of the disorder, such as edema swelling of the extremities, face, larynx, upper respiratory tract, abdomen, trunk and genitals; prodrome; laryngeal swelling; nonpruritic rash; nausea; vomiting; or abdominal pain. Ameliorating the disease includes slowing the course of the disease or reducing the severity of later-developing disease. The "prophylactically effective amount" may vary depending on the RNAi agent, how the agent is administered, the degree of risk of disease, and the history, age, weight, family history, genetic makeup, the types of preceding or concomitant treatments, if any, and other individual characteristics of the patient to be treated.

A "therapeutically-effective amount" or "prophylactically effective amount" also includes an amount of an RNAi agent that produces some desired effect at a reasonable benefit/risk ratio applicable to any treatment. The iRNA employed in the methods of the present invention may be administered in a sufficient amount to produce a reasonable benefit/risk ratio applicable to such treatment.

The phrase "pharmaceutically acceptable" is employed herein to refer to those compounds, materials (including salts), compositions, or dosage forms which are, within the scope of sound medical judgment, suitable for use in contact with the tissues of human subjects and animal subjects without excessive toxicity, irritation, allergic response, or other problem or complication, commensurate with a reasonable benefit/risk ratio.

The phrase "pharmaceutically-acceptable carrier" as used herein means a pharmaceutically-acceptable material, composition, or vehicle, such as a liquid or solid filler, diluent, excipient, manufacturing aid (e.g., lubricant, talc magnesium, calcium or zinc stearate, or steric acid), or solvent encapsulating material, involved in carrying or transporting the subject compound from one organ, or portion of the body, to another organ, or portion of the body. Each carrier must be "acceptable" in the sense of being compatible with the other ingredients of the formulation and not injurious to the subject being treated. Such carriers are known in the art. Pharmaceutically acceptable carriers include carriers for administration by injection.

The term "sample," as used herein, includes a collection of similar fluids, cells, or tissues isolated from a subject, as well as fluids, cells, or tissues present within a subject. Examples of biological fluids include blood, serum and serosal fluids, plasma, cerebrospinal fluid, ocular fluids, lymph, urine, saliva, and the like. Tissue samples may include samples from tissues, organs, or localized regions. For example, samples may be derived from particular organs, parts of organs, or fluids or cells within those organs. In certain embodiments, samples may be derived from the liver (e.g., whole liver or certain segments of liver or certain types of cells in the liver, such as, e.g., hepatocytes). In some embodiments, a "sample derived from a subject" refers to urine obtained from the subject. A "sample derived from a subject" can refer to blood or blood derived serum or plasma from the subject.

II. iRNAs of the Invention

The present invention provides iRNAs which inhibit the expression of an F12 gene. In certain embodiments, the iRNA includes double stranded ribonucleic acid (dsRNA) molecules for inhibiting the expression of an F12 gene in a cell, such as a cell within a subject, e.g., a mammal, such as a human susceptible to developing an F12-associated disorder, e.g., heredity angioedema (HAE) (e.g., hereditary angioedema type I; hereditary angioedema type II; hereditary angioedema type III; or any other hereditary angioedema caused by elevated levels of bradykinin); prekallikrein deficiency, hypertension, e.g., malignant essential hypertension, end stage renal disease, Fletcher Factor Deficiency, thromboembolic disease, inflammatory disease, or Alzheimer's Disease. The dsRNAi agent includes an antisense strand having a region of complementarity which is complementary to at least a part of an mRNA formed in the expression of an F12 gene. The region of complementarity is about 19-30 nucleotides in length (e.g., about 30, 29, 28, 27, 26, 25, 24, 23, 22, 21, 20, or 19 nucleotides in length).

Upon contact with a cell expressing the F12 gene, the iRNA inhibits the expression of the F12 gene (e.g., a human, a primate, a non-primate, or a rat F12 gene) by at least about 50% as assayed by, for example, a PCR or branched DNA (bDNA)-based method, or by a protein-based method, such as by immunofluorescence analysis, using, for example, western blotting or flow cytometric techniques. In certain embodiments, inhibition of expression is determined by the qPCR method provided in the examples herein with the siRNA at, e.g., a 10 nM concentration, in an appropriate organism cell line provided therein. In certain embodiments, inhibition of expression in vivo is determined by knockdown of the human gene in a rodent expressing the human gene, e.g., a mouse or an AAV-infected mouse expressing the human target gene, e.g., when administered as single dose, e.g., at 3 mg/kg at the nadir of RNA expression.

A dsRNA includes two RNA strands that are complementary and hybridize to form a duplex structure under conditions in which the dsRNA will be used. One strand of a dsRNA (the antisense strand) includes a region of complementarity that is substantially complementary, and generally fully complementary, to a target sequence. The target sequence can be derived from the sequence of an mRNA formed during the expression of an F12 gene. The other strand (the sense strand) includes a region that is complementary to the antisense strand, such that the two strands hybridize and form a duplex structure when combined under suitable conditions. As described elsewhere herein and as known in the art, the complementary sequences of a dsRNA can also be contained as self-complementary regions of a single nucleic acid molecule, as opposed to being on separate oligonucleotides.

Generally, the duplex structure is 15 to 30 base pairs in length, e.g., 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24,20-23, 20-22, 20-21, 21-30, 21-29, 21-28, 21-27, 21-26, 21-25, 21-24, 21-23, or 21-22 base pairs in length. In certain embodiments, the duplex structure is 18 to 25 base pairs in length, e.g., 18-25, 18-24, 18-23, 18-22, 18-21, 18-20, 19-25, 19-24, 19-23, 19-22, 19-21, 19-20, 20-25, 20-24,20-23, 20-22, 20-21, 21-25, 21-24, 21-23, 21-22, 22-25, 22-24, 22-23, 23-25, 23-24 or 24-25 base pairs in length, for example, 19-21 basepairs in length. Ranges and lengths intermediate to the above recited ranges and lengths are also contemplated to be part of the disclosure.

Similarly, the region of complementarity to the target sequence is 15 to 30 nucleotides in length, e.g., 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24,20-23, 20-22, 20-21, 21-30, 21-29, 21-28, 21-27, 21-26, 21-25, 21-24, 21-23, or 21-22 nucleotides in length, for example 19-23 nucleotides in length or 21-23 nucleotides in length. Ranges and lengths intermediate to the above recited ranges and lengths are also contemplated to be part of the disclosure.

In some embodiments, the duplex structure is 19 to 30 base pairs in length. Similarly, the region of complementarity to the target sequence is 19 to 30 nucleotides in length.

In some embodiments, the dsRNA is about 19 to about 23 nucleotides in length, or about 25 to about 30 nucleotides in length. In general, the dsRNA is long enough to serve as a substrate for the Dicer enzyme. For example, it is well-known in the art that dsRNAs longer than about 21-23 nucleotides in length may serve as substrates for Dicer. As the ordinarily skilled person will also recognize, the region of an RNA targeted for cleavage will most often be part of a larger RNA molecule, often an mRNA molecule. Where relevant, a "part" of an mRNA target is a contiguous sequence of an mRNA target of sufficient length to allow it to be a substrate for RNAi-directed cleavage (i.e., cleavage through a RISC pathway).

One of skill in the art will also recognize that the duplex region is a primary functional portion of a dsRNA, e.g., a duplex region of about 19 to about 30 base pairs, e.g., about 19-30, 19-29, 19-28, 19-27, 19-26, 19-25, 19-24, 19-23, 19-22, 19-21, 19-20, 20-30, 20-29, 20-28, 20-27, 20-26, 20-25, 20-24,20-23, 20-22, 20-21, 21-30, 21-29, 21-28, 21-27, 21-26, 21-25, 21-24, 21-23, or 21-22 base pairs. Thus, in one embodiment, to the extent that it becomes processed to a functional duplex, of e.g., 15-30 base pairs, that targets a desired RNA for cleavage, an RNA molecule or complex of RNA molecules having a duplex region greater than 30 base pairs is a dsRNA. Thus, an ordinarily skilled artisan will recognize that in one embodiment, a miRNA is a dsRNA. In another embodiment, a dsRNA is not a naturally occurring miRNA. In another embodiment, an iRNA agent useful to target F12 gene expression is not generated in the target cell by cleavage of a larger dsRNA.

A dsRNA as described herein can further include one or more single-stranded nucleotide overhangs, e.g., 1-4, 2-4, 1-3, 2-3, 1, 2, 3, or 4 nucleotides. dsRNAs having at least one nucleotide overhang can have superior inhibitory properties relative to their blunt-ended counterparts. A nucleotide overhang can comprise or consist of a nucleotide/nucleoside analog, including a deoxynucleotide/nucleoside. The overhang(s) can be on the sense strand, the antisense strand, or any combination thereof. Furthermore, the nucleotide(s) of an overhang can be present on the 5'-end, 3'-end, or both ends of an antisense or sense strand of a dsRNA.

A dsRNA can be synthesized by standard methods known in the art. Double stranded RNAi compounds of the invention may be prepared using a two-step procedure. First, the individual strands of the double stranded RNA molecule are prepared separately. Then, the component strands are annealed. The individual strands of the siRNA compound can be prepared using solution-phase or solid-phase organic synthesis or both. Organic synthesis offers the advantage that the oligonucleotide strands comprising unnatural or modified nucleotides can be easily prepared. Similarly, single-stranded oligonucleotides of the invention can be prepared using solution-phase or solid-phase organic synthesis or both.

In an aspect, a dsRNA of the invention includes at least two nucleotide sequences, a sense sequence and an antisense sequence. The sense strand is selected from the group of sequences provided in any one of Tables 2-3, and the corresponding antisense strand of the sense strand is selected from the group of sequences of any one of Tables 2-3. In this aspect, one of the two sequences is complementary to the other of the two sequences, with one of the sequences being substantially complementary to a sequence of an mRNA generated in the expression of an F12 gene. As such, in this aspect, a dsRNA will include two oligonucleotides, where one oligonucleotide is described as the sense strand in any one of Tables 2-3, and the second oligonucleotide is described as the corresponding antisense strand of the sense strand in any one of Tables 2-3.

In certain embodiments, the substantially complementary sequences of the dsRNA are contained on separate oligonucleotides. In other embodiments, the substantially complementary sequences of the dsRNA are contained on a single oligonucleotide.

It will be understood that, although the sequences in, for example, Table 3, are not described as modified or conjugated sequences, the RNA of the iRNA of the invention e.g., a dsRNA of the invention, may comprise any one of the sequences set forth in any one of Tables 2-3 that is un-modified, un-conjugated, or modified or conjugated differently than described therein. In other words, the invention encompasses dsRNA of Tables 2-3 which are un-modified, un-conjugated, modified, or conjugated, as described herein.

The skilled person is well aware that dsRNAs having a duplex structure of about 20 to 23 base pairs, e.g., 21, base pairs have been hailed as particularly effective in inducing RNA interference (Elbashir et al., *EMBO* 2001, 20:6877-6888). However, others have found that shorter or longer RNA duplex structures can also be effective (Chu and Rana (2007) *RNA* 14:1714-1719; Kim et al. (2005) *Nat Biotech* 23:222-226). In the embodiments described above, by virtue of the nature of the oligonucleotide sequences provided in any one of Tables 2-3. dsRNAs described herein can include at least one strand of a length of minimally 21 nucleotides. It can be reasonably expected that shorter duplexes having any one of the sequences in any one of Tables 2-3 minus only a few nucleotides on one or both ends can be similarly effective as compared to the dsRNAs described above. Hence, dsRNAs having a sequence of at least 19, 20, or more contiguous nucleotides derived from any one of the sequences of any one of Tables 2-3, and differing in their ability to inhibit the expression of an F12 gene by not more than about 5, 10, 15, 20, 25, or 30% inhibition from a dsRNA comprising the full sequence, are contemplated to be within the scope of the present invention.

In addition, the RNAs provided in Tables 2-3 identify a site(s) in an F12 transcript that is susceptible to RISC-mediated cleavage. As such, the present invention further features iRNAs that target within one of these sites. As used herein, an iRNA is said to target within a particular site of an RNA transcript if the iRNA promotes cleavage of the transcript anywhere within that particular site. Such an iRNA will generally include at least about 19 contiguous nucleotides from any one of the sequences provided in any one of Tables 2-3 coupled to additional nucleotide sequences taken from the region contiguous to the selected sequence in an F12 gene.

III. Modified iRNAs of the Invention

In certain embodiments, the RNA of the iRNA of the invention e.g., a dsRNA, is un-modified, and does not comprise, e.g., chemical modifications or conjugations known in the art and described herein. In other embodiments, the RNA of an iRNA of the invention, e.g., a dsRNA, is chemically modified to enhance stability or other beneficial characteristics. In certain embodiments of the invention, substantially all of the nucleotides of an iRNA of the invention are modified. In other embodiments of the invention, all of the nucleotides of an iRNA or substantially all of the nucleotides of an iRNA are modified, i.e., not more than 5, 4, 3, 2, or 1 unmodified nucleotides are present in a strand of the iRNA.

The nucleic acids featured in the invention can be synthesized or modified by methods well established in the art, such as those described in "Current protocols in nucleic acid chemistry," Beaucage, S. L. et al. (Edrs.), John Wiley & Sons, Inc., New York, NY, USA, which is hereby incorporated herein by reference. Modifications include, for example, end modifications, e.g., 5'-end modifications (phosphorylation, conjugation, inverted linkages) or 3'-end modifications (conjugation, DNA nucleotides, inverted linkages, etc.); base modifications, e.g., replacement with stabilizing bases, destabilizing bases, or bases that base pair with an expanded repertoire of partners, removal of bases (abasic nucleotides), or conjugated bases; sugar modifications (e.g., at the 2'-position or 4'-position) or replacement of the sugar; or backbone modifications, including modification or replacement of the phosphodiester linkages. Specific examples of iRNA compounds useful in the embodiments described herein include, but are not limited to RNAs containing modified backbones or no natural internucleoside linkages. RNAs having modified backbones include, among others, those that do not have a phosphorus atom in the backbone. For the purposes of this specification, and as sometimes referenced in the art, modified RNAs that do not have a phosphorus atom in their internucleoside backbone can also be considered to be oligonucleosides. In some embodiments, a modified iRNA will have a phosphorus atom in its internucleoside backbone.

Modified RNA backbones include, for example, phosphorothioates, chiral phosphorothioates, phosphorodithioates, phosphotriesters, aminoalkylphosphotriesters, methyl and other alkyl phosphonates including 3'-alkylene phosphonates and chiral phosphonates, phosphinates, phosphoramidates including 3'-amino phosphoramidate and aminoalkylphosphoramidates, thionophosphoramidates, thionoalkylphosphonates, thionoalkylphosphotriesters, and boranophosphates having normal 3'-5' linkages, 2'-5'-linked analogs of these, and those having inverted polarity wherein the adjacent pairs of nucleoside units are linked 3'-5' to 5'-3' or 2'-5' to 5'-2'. Various salts, mixed salts and free acid forms are also included. In some embodiments of the invention, the dsRNA agents of the invention are in a free acid form. In other embodiments of the invention, the dsRNA agents of the invention are in a salt form. In one embodiment, the dsRNA agents of the invention are in a sodium salt form. In certain embodiments, when the dsRNA agents of the invention are in the sodium salt form, sodium ions are present in the agent as counterions for substantially all of the phosphodiester and/or phosphorothioate groups present in the agent. Agents in which substantially all of the phosphodiester and/or phosphorothioate linkages have a sodium counterion include not more than 5, 4, 3, 2, or 1 phosphodiester and/or phosphorothioate linkages without a sodium counterion. In some embodiments, when the dsRNA agents of the invention are in the sodium salt form, sodium ions are present in the agent as counterions for all of the phosphodiester and/or phosphorothioate groups present in the agent.

Representative U.S. Patents that teach the preparation of the above phosphorus-containing linkages include, but are not limited to, U.S. Pat. Nos. 3,687,808; 4,469,863; 4,476,301; 5,023,243; 5,177,195; 5,188,897; 5,264,423; 5,276,019; 5,278,302; 5,286,717; 5,321,131; 5,399,676; 5,405,939; 5,453,496; 5,455,233; 5,466,677; 5,476,925; 5,519,126; 5,536,821; 5,541,316; 5,550,111; 5,563,253; 5,571,799; 5,587,361; 5,625,050; 6,028,188; 6,124,445; 6,160,109; 6,169,170; 6,172,209; 6,239,265; 6,277,603; 6,326,199; 6,346,614; 6,444,423; 6,531,590; 6,534,639; 6,608,035; 6,683,167; 6,858,715; 6,867,294; 6,878,805; 7,015,315; 7,041,816; 7,273,933; 7,321,029; and U.S. Pat. RE39464, the entire contents of each of which are hereby incorporated herein by reference.

Modified RNA backbones that do not include a phosphorus atom therein have backbones that are formed by short chain alkyl or cycloalkyl internucleoside linkages, mixed heteroatoms and alkyl or cycloalkyl internucleoside linkages, or one or more short chain heteroatomic or heterocyclic internucleoside linkages. These include those having morpholino linkages (formed in part from the sugar portion of a nucleoside); siloxane backbones; sulfide, sulfoxide and sulfone backbones; formacetyl and thioformacetyl backbones; methylene formacetyl and thioformacetyl backbones; alkene containing backbones; sulfamate backbones; methyleneimino and methylenehydrazino backbones; sulfonate and sulfonamide backbones; amide backbones; and others having mixed N, O, S, and $CH_2$ component parts.

Representative U.S. Patents that teach the preparation of the above oligonucleosides include, but are not limited to, U.S. Pat. Nos. 5,034,506; 5,166,315; 5,185,444; 5,214,134; 5,216,141; 5,235,033; 5,64,562; 5,264,564; 5,405,938; 5,434,257; 5,466,677; 5,470,967; 5,489,677; 5,541,307; 5,561,225; 5,596,086; 5,602,240; 5,608,046; 5,610,289; 5,618,704; 5,623,070; 5,663,312; 5,633,360; 5,677,437; and 5,677,439, the entire contents of each of which are hereby incorporated herein by reference.

Suitable RNA mimetics are contemplated for use in iRNAs provided herein, in which both the sugar and the internucleoside linkage, i.e., the backbone, of the nucleotide units are replaced with novel groups. The base units are maintained for hybridization with an appropriate nucleic acid target compound. One such oligomeric compound in which an RNA mimetic that has been shown to have excellent hybridization properties is referred to as a peptide nucleic acid (PNA). In PNA compounds, the sugar backbone of an RNA is replaced with an amide containing backbone, in particular an aminoethylglycine backbone. The nucleobases are retained and are bound directly or indirectly to aza nitrogen atoms of the amide portion of the backbone. Representative US patents that teach the preparation of PNA compounds include, but are not limited to, U.S. Pat. Nos. 5,539,082; 5,714,331; and 5,719,262, the entire contents of each of which are hereby incorporated herein by reference. Additional PNA compounds suitable for use in the iRNAs of the invention are described in, for example, in Nielsen et al., *Science*, 1991, 254, 1497-1500.

Some embodiments featured in the invention include RNAs with phosphorothioate backbones and oligonucleosides with heteroatom backbones, and in particular —$CH_2$—NH—$CH_2$—, —$CH_2$—N($CH_3$)—O—$CH_2$—[known as a methylene (methylimino) or MMI backbone], —$CH_2$—O—N($CH_3$)—$CH_2$—, —$CH_2$—N($CH_3$)—N($CH_3$)—$CH_2$— and —N($CH_3$)—$CH_2$—$CH_2$— of the above-referenced U.S. Pat. No. 5,489,677, and the amide backbones of the above-referenced U.S. Pat. No. 5,602,240. In some embodiments, the RNAs featured herein have morpholino backbone structures of the above-referenced U.S. Pat. No. 5,034,506. The native phosphodiester backbone can be represented as O—P(O)(OH)—$OCH_2$—.

Modified RNAs can also contain one or more substituted sugar moieties. The iRNAs, e.g., dsRNAs, featured herein can include one of the following at the 2'-position: OH; F; O—, S—, or N-alkyl; O—, S—, or N-alkenyl; O—, S- or N-alkynyl; or O-alkyl-O-alkyl, wherein the alkyl, alkenyl and alkynyl can be substituted or unsubstituted $C_1$ to $C_{10}$ alkyl or $C_2$ to $C_{10}$ alkenyl and alkynyl. Exemplary suitable modifications include O[($CH_2$)·O]$_m$ $CH_3$, O($CH_2$)·$_n$$OCH_3$, O($CH_2$)·$NH_2$, O($CH_2$)·$CH_3$, O($CH_2$)$_n$$ONH_2$, and O($CH_2$)$_n$ON[($CH_2$)$_n$$CH_3$)]$_2$, where n and m are from 1 to about 10. In other embodiments, dsRNAs include one of the following at the 2' position: $C_1$ to $C_{10}$ lower alkyl, substituted lower alkyl, alkaryl, aralkyl, O-alkaryl or O-aralkyl, SH, $SCH_3$, OCN, Cl, Br, CN, $CF_3$, $OCF_3$, $SOCH_3$, $SO_2CH_3$, $ONO_2$, $NO_2$, $N_3$, $NH_2$, heterocycloalkyl, heterocycloalkaryl, aminoalkylamino, polyalkylamino, substituted silyl, an RNA cleaving group, a reporter group, an intercalator, a group for improving the pharmacokinetic properties of an iRNA, or a group for improving the pharmacodynamic properties of an iRNA, and other substituents having similar properties. In some embodiments, the modification includes a 2'-methoxyethoxy (2'-O—$CH_2CH_2OCH_3$, also known as 2'-O-(2-methoxyethyl) or 2'-MOE) (Martin et al., *Helv. Chim. Acta*, 1995, 78:486-504) i.e., an alkoxy-alkoxy group. Another exemplary modification is 2'-dimethylaminooxyethoxy, i.e., a O($CH_2$)$_2$ON($CH_3$)$_2$ group, also known as 2'-DMAOE, as described in examples herein below, and 2'-dimethylaminoethoxyethoxy (also known in the art as 2'-O-dimethylaminoethoxyethyl or 2'-DMAEOE), i.e., 2'-O—$CH_2$—O—$CH_2$—N($CH_3$)$_2$. Further exemplary modifications include: 5'-Me-2'-F nucleotides, 5'-Me-2'-OMe nucleotides, 5'-Me-2'-deoxynucleotides, (both R and S isomers in these three families); 2'-alkoxyalkyl; and 2'-NMA (N-methylacetamide).

Other modifications include 2'-methoxy (2'-$OCH_3$), 2'-aminopropoxy (2'-$OCH_2CH_2CH_2NH_2$) and 2'-fluoro (2'-F). Similar modifications can also be made at other positions on the RNA of an iRNA, particularly the 3' position of the sugar on the 3' terminal nucleotide or in 2'-5' linked dsRNAs and the 5' position of 5' terminal nucleotide. iRNAs can also have sugar mimetics such as cyclobutyl moieties in place of the pentofuranosyl sugar. Representative US patents that teach the preparation of such modified sugar structures include, but are not limited to, U.S. Pat. Nos. 4,981,957; 5,118,800; 5,319,080; 5,359,044; 5,393,878; 5,446,137; 5,466,786; 5,514,785; 5,519,134; 5,567,811; 5,576,427; 5,591,722; 5,597,909; 5,610,300; 5,627,053; 5,639,873; 5,646,265; 5,658,873; 5,670,633; and 5,700,920, certain of which are commonly owned with the instant application. The entire contents of each of the foregoing are hereby incorporated herein by reference.

An iRNA can also include nucleobase (often referred to in the art simply as "base") modifications or substitutions. As used herein, "unmodified" or "natural" nucleobases include the purine bases adenine (A) and guanine (G), and the pyrimidine bases thymine (T), cytosine (C), and uracil (U). Modified nucleobases include other synthetic and natural nucleobases such as deoxythimidine (dT), 5-methylcytosine (5-me-C), 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl uracil and cytosine, 6-azo uracil, cytosine and thymine, 5-uracil (pseudouracil), 4-thiouracil, 8-halo, 8-amino, 8-thiol, 8-thioalkyl, 8-hydroxyl anal other 8-substituted adenines and guanines, 5-halo, particularly 5-bromo, 5-trifluoromethyl and other 5-substituted uracils and cytosines, 7-methylguanine and 7-methyladenine, 8-azaguanine and 8-azaadenine, 7-deazaguanine and 7-daazaadenine and 3-deazaguanine and 3-deazaadenine. Further nucleobases include those disclosed in U.S. Pat. No. 3,687,808, those disclosed in Modified Nucleosides in Biochemistry, Biotechnology and Medicine, Herdewijn, P. ed. Wiley-VCH, 2008; those disclosed in The Concise Encyclopedia Of Polymer Science And Engineering, pages 858-859, Kroschwitz, J. L, ed. John Wiley & Sons, 1990, these disclosed by Englisch et al., Angewandte Chemie, International Edition, 1991, 30, 613, and those disclosed by Sanghvi, Y S., Chapter 15, dsRNA Research and Applications, pages 289-302, Crooke, S. T. and Lebleu, B., Ed., CRC Press, 1993. Certain of these nucleobases are particularly useful for increasing the binding affinity of the oligomeric compounds featured in the invention. These include 5-substituted pyrimidines, 6-azapyrimidines and N-2, N-6 and 0-6 substituted purines, including 2-aminopropyladenine, 5-propynyluracil and 5-propynylcytosine. 5-methylcytosine substitutions have been shown to increase nucleic acid duplex stability by 0.6-1.2° C. (Sanghvi, Y. S., Crooke, S. T. and Lebleu, B., Eds., dsRNA Research and Applications, CRC Press, Boca Raton, 1993, pp. 276-278) and are exemplary base substitutions, even more particularly when combined with 2'-O-methoxyethyl sugar modifications.

Representative U.S. Patents that teach the preparation of certain of the above noted modified nucleobases as well as other modified nucleobases include, but are not limited to, the above noted U.S. Pat. Nos. 3,687,808, 4,845,205; 5,130, 30; 5,134,066; 5,175,273; 5,367,066; 5,432,272; 5,457,187; 5,459,255; 5,484,908; 5,502,177; 5,525,711; 5,552,540; 5,587,469; 5,594,121; 5,596,091; 5,614,617; 5,681,941; 5,750,692; 6,015,886; 6,147,200; 6,166,197; 6,222,025; 6,235,887; 6,380,368; 6,528,640; 6,639,062; 6,617,438; 7,045,610; 7,427,672; and 7,495,088, the entire contents of each of which are hereby incorporated herein by reference.

In some embodiments, an RNAi agent of the disclosure can also be modified to include one or more bicyclic sugar moieties. A "bicyclic sugar" is a furanosyl ring modified by a ring formed by the bridging of two carbons, whether adjacent or non-adjacent. A "bicyclic nucleoside" ("BNA") is a nucleoside having a sugar moiety comprising a ring formed by bridging two carbons, whether adjacent or non-adjacent, of the sugar ring, thereby forming a bicyclic ring system. In certain embodiments, the bridge connects the 4'-carbon and the 2'-carbon of the sugar ring, optionally, via the 2'-acyclic oxygen atom. Thus, in some embodiments an agent of the invention may include one or more locked nucleic acids (LNA). A locked nucleic acid is a nucleotide having a modified ribose moiety in which the ribose moiety comprises an extra bridge connecting the 2' and 4' carbons. In other words, an LNA is a nucleotide comprising a bicyclic sugar moiety comprising a 4'-$CH_2$—O-2' bridge. This structure effectively "locks" the ribose in the 3'-endo structural conformation. The addition of locked nucleic acids to siRNAs has been shown to increase siRNA stability in serum, and to reduce off-target effects (Elmen, J. et al., (2005) Nucleic Acids Research 33(1):439-447; Mook, O R. et al., (2007) Mol Canc Ther 6(3):833-843; Grunweller, A. et al., (2003) Nucleic Acids Research 31(12):3185-3193). Examples of bicyclic nucleosides for use in the polynucleotides of the invention include without limitation nucleosides comprising a bridge between the 4' and the 2' ribosyl ring atoms. In certain embodiments, the antisense polynucleotide agents of the invention include one or more bicyclic nucleosides comprising a 4' to 2' bridge.

A locked nucleoside can be represented by the structure (omitting stereochemistry),

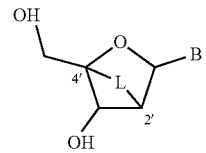

wherein B is a nucleobase or modified nucleobase and L is the linking group that joins the 2'-carbon to the 4'-carbon of the ribose ring. Examples of such 4' to 2' bridged bicyclic nucleosides, include but are not limited to 4'-($CH_2$)—O-2' (LNA); 4'-($CH_2$)—S-2'; 4'-($CH_2$)$_2$—O-2' (ENA); 4'-$CH(CH_3)$—O-2' (also referred to as "constrained ethyl" or "cEt") and 4'-CH($CH_2OCH_3$)—O-2' (and analogs thereof; see, e.g., U.S. Pat. No. 7,399,845); 4'-$C(CH_3)(CH_3)$—O-2' (and analogs thereof; see e.g., U.S. Pat. No. 8,278,283); 4'-$CH_2$—N($OCH_3$)-2' (and analogs thereof; see e.g., U.S. Pat. No. 8,278,425); 4'-$CH_2$—O—N($CH_3$)-2' (see, e.g., U.S. Patent Publication No. 2004/0171570); 4'-$CH_2$—N(R)—O-2', wherein R is H, C1-C12 alkyl, or a nitrogen protecting group (see, e.g., U.S. Pat. No. 7,427,672); 4'-$CH_2$—C(H)($CH_3$)-2' (see, e.g., Chattopadhyaya et al., J. Org. Chem., 2009, 74, 118-134); and 4'-$CH_2$—C(=$CH_2$)-2' (and analogs thereof; see, e.g., U.S. Pat. No. 8,278,426). The entire contents of each of the foregoing are hereby incorporated herein by reference.

Additional representative U.S. Patents and U.S. Patent Publications that teach the preparation of locked nucleic acid nucleotides include, but are not limited to, the following: U.S. Pat. Nos. 6,268,490; 6,525,191; 6,670,461; 6,770,748; 6,794,499; 6,998,484; 7,053,207; 7,034,133; 7,084,125; 7,399,845; 7,427,672; 7,569,686; 7,741,457; 8,022,193; 8,030,467; 8,278,425; 8,278,426; 8,278,283; US 2008/

0039618; and US 2009/0012281, the entire contents of each of which are hereby incorporated herein by reference.

Any of the foregoing bicyclic nucleosides can be prepared having one or more stereochemical sugar configurations including for example α-L-ribofuranose and β-D-ribofuranose (see WO 99/14226).

The RNA of an iRNA can also be modified to include one or more constrained ethyl nucleotides. As used herein, a "constrained ethyl nucleotide" or "cEt" is a locked nucleic acid comprising a bicyclic sugar moiety comprising a 4'-CH(CH$_3$)—O-2' bridge (i.e., L in the preceding structure). In one embodiment, a constrained ethyl nucleotide is in the S conformation referred to herein as "S-cEt."

An iRNA of the invention may also include one or more "conformationally restricted nucleotides" ("CRN"). CRN are nucleotide analogs with a linker connecting the C2' and C4' carbons of ribose or the C3 and -C5' carbons of ribose. CRN lock the ribose ring into a stable conformation and increase the hybridization affinity to mRNA. The linker is of sufficient length to place the oxygen in an optimal position for stability and affinity resulting in less ribose ring puckering.

Representative publications that teach the preparation of certain of the above noted CRN include, but are not limited to, U.S. Patent Publication No. 2013/0190383; and PCT publication WO 2013/036868, the entire contents of each of which are hereby incorporated herein by reference.

In some embodiments, an iRNA of the invention comprises one or more monomers that are UNA (unlocked nucleic acid) nucleotides. UNA is unlocked acyclic nucleic acid, wherein any of the bonds of the sugar has been removed, forming an unlocked "sugar" residue. In one example, UNA also encompasses monomer with bonds between C1'-C4' have been removed (i.e. the covalent carbon-oxygen-carbon bond between the C1' and C4' carbons). In another example, the C2'-C3' bond (i.e. the covalent carbon-carbon bond between the C2' and C3' carbons) of the sugar has been removed (see *Nuc. Acids Symp. Series*, 52, 133-134 (2008) and Fluiter et al., *Mol. Biosyst.*, 2009, 10, 1039 hereby incorporated by reference).

Representative U.S. publications that teach the preparation of UNA include, but are not limited to, U.S. Pat. No. 8,314,227; and U.S. Patent Publication Nos. 2013/0096289; 2013/0011922; and 2011/0313020, the entire contents of each of which are hereby incorporated herein by reference.

Potentially stabilizing modifications to the ends of RNA molecules can include N-(acetylaminocaproyl)-4-hydroxyprolinol (Hyp-C6-NHAc), N-(caproyl-4-hydroxyprolinol (Hyp-C6), N-(acetyl-4-hydroxyprolinol (Hyp-NHAc), thymidine-2'-O-deoxythymidine (ether), N-(aminocaproyl)-4-hydroxyprolinol (Hyp-C6-amino), 2-docosanoyl-uridine-3'-phosphate, inverted 2'-deoxy-modified ribonucleotide, such as inverted dT(idT), inverted dA (idA), and inverted abasic 2'-deoxyribonucleotide (iAb) and others. Disclosure of this modification can be found in WO 2011/005861.

In one example, the 3' or 5' terminal end of a oligonucleotide is linked to an inverted 2'-deoxy-modified ribonucleotide, such as inverted dT(idT), inverted dA (idA), or a inverted abasic 2'-deoxyribonucleotide (iAb). In one particular example, the inverted 2'-deoxy-modified ribonucleotide is linked to the 3'end of an oligonucleotide, such as the 3'-end of a sense strand described herein, where the linking is via a 3'-3' phosphodiester linkage or a 3'-3'-phosphorothioate linkage.

In another example, the 3'-end of a sense strand is linked via a 3'-3'-phosphorothioate linkage to an inverted abasic ribonucleotide (iAb). In another example, the 3'-end of a sense strand is linked via a 3'-3'-phosphorothioate linkage to an inverted dA (idA).

In one particular example, the inverted 2'-deoxy-modified ribonucleotide is linked to the 3'end of an oligonucleotide, such as the 3'-end of a sense strand described herein, where the linking is via a 3'-3' phosphodiester linkage or a 3'-3'-phosphorothioate linkage.

In another example, the 3'-terminal nucleotides of a sense strand is an inverted dA (idA) and is linked to the preceding nucleotide via a 3'-3'-linkage (e.g., 3'-3'-phosphorothioate linkage). Other modifications of the nucleotides of an iRNA of the invention include a 5' phosphate or 5' phosphate mimic, e.g., a 5'-terminal phosphate or phosphate mimic on the antisense strand of an iRNA. Suitable phosphate mimics are disclosed in, for example U.S. Patent Publication No. 2012/0157511, the entire contents of which are incorporated herein by reference.

A. Modified iRNAs Comprising Motifs of the Invention

In certain aspects of the invention, the double stranded RNA agents of the invention include agents with chemical modifications as disclosed, for example, in WO2013/075035, the entire contents of each of which are incorporated herein by reference. As shown herein and in WO2013/075035, one or more motifs of three identical modifications on three consecutive nucleotides may be introduced into a sense strand or antisense strand of a dsRNAi agent, particularly at or near the cleavage site. In some embodiments, the sense strand and antisense strand of the dsRNAi agent may otherwise be completely modified. The introduction of these motifs interrupts the modification pattern, if present, of the sense or antisense strand. The dsRNAi agent may be optionally conjugated with a GalNAc derivative ligand, for instance on the sense strand.

More specifically, when the sense strand and antisense strand of the double stranded RNA agent are completely modified to have one or more motifs of three identical modifications on three consecutive nucleotides at or near the cleavage site of at least one strand of a dsRNAi agent, the gene silencing activity of the dsRNAi agent was observed.

Accordingly, the invention provides double stranded RNA agents capable of inhibiting the expression of a target gene (i.e., F12 gene) in vivo. The RNAi agent comprises a sense strand and an antisense strand. Each strand of the RNAi agent may be, for example, 17-30 nucleotides in length, 25-30 nucleotides in length, 27-30 nucleotides in length, 19-25 nucleotides in length, 19-23 nucleotides in length, 19-21 nucleotides in length, 21-25 nucleotides in length, or 21-23 nucleotides in length.

The sense strand and antisense strand typically form a duplex double stranded RNA ("dsRNA"), also referred to herein as "dsRNAi agent." The duplex region of a dsRNAi agent may be, for example, the duplex region can be 27-30 nucleotide pairs in length, 19-25 nucleotide pairs in length, 19-23 nucleotide pairs in length, 19-21 nucleotide pairs in length, 21-25 nucleotide pairs in length, or 21-23 nucleotide pairs in length. In another example, the duplex region is selected from 19, 20, 21, 22, 23, 24, 25, 26, and 27 nucleotides in length.

In certain embodiments, the dsRNAi agent may contain one or more overhang regions or capping groups at the 3'-end, 5'-end, or both ends of one or both strands. The overhang can be, independently, 1-6 nucleotides in length, for instance 2-6 nucleotides in length, 1-5 nucleotides in length, 2-5 nucleotides in length, 1-4 nucleotides in length, 2-4 nucleotides in length, 1-3 nucleotides in length, 2-3 nucleotides in length, or 1-2 nucleotides in length. In certain embodiments, the overhang regions can include extended overhang regions as provided above. The overhangs can be the result of one strand being longer than the other, or the result of two strands of the same length being staggered. The overhang can form a mismatch with the target mRNA or it can be complementary to the gene sequences being targeted or can be another sequence. The first and second strands can also be joined, e.g., by additional bases to form a hairpin, or by other non-base linkers.

In certain embodiments, the nucleotides in the overhang region of the dsRNAi agent can each independently be a modified or unmodified nucleotide including, but no limited to 2'-sugar modified, such as, 2'-F, 2'-O-methyl, thymidine (T), 2'-O-methoxyethyl-5-methyluridine (Teo), 2'-O-methoxyethyladenosine (Aeo), 2'-O-methoxyethyl-5-methylcytidine (m5Ceo), and any combinations thereof.

For example, TT can be an overhang sequence for either end on either strand. The overhang can form a mismatch with the target mRNA or it can be complementary to the gene sequences being targeted or can be another sequence.

The 5'- or 3'-overhangs at the sense strand, antisense strand, or both strands of the dsRNAi agent may be phosphorylated. In some embodiments, the overhang region(s) contains two nucleotides having a phosphorothioate between the two nucleotides, where the two nucleotides can be the same or different. In some embodiments, the overhang is present at the 3'-end of the sense strand, antisense strand, or both strands. In some embodiments, this 3'-overhang is present in the antisense strand. In some embodiments, this 3'-overhang is present in the sense strand.

The dsRNAi agent may contain only a single overhang, which can strengthen the interference activity of the RNAi, without affecting its overall stability. For example, the single-stranded overhang may be located at the 3'-end of the sense strand or, alternatively, at the 3'-end of the antisense strand. The RNAi may also have a blunt end, located at the 5'-end of the antisense strand (i.e., the 3'-end of the sense strand) or vice versa. Generally, the antisense strand of the dsRNAi agent has a nucleotide overhang at the 3'-end, and the 5'-end is blunt. While not wishing to be bound by theory, the asymmetric blunt end at the 5'-end of the antisense strand and 3'-end overhang of the antisense strand favor the guide strand loading into RISC process.

In certain embodiments, the dsRNAi agent is a double blunt-ended of 19 nucleotides in length, wherein the sense strand contains at least one motif of three 2'-F modifications on three consecutive nucleotides at positions 7, 8, 9 from the 5'end. The antisense strand contains at least one motif of three 2'-O-methyl modifications on three consecutive nucleotides at positions 11, 12, and 13 from the 5'end.

In other embodiments, the dsRNAi agent is a double blunt-ended of 20 nucleotides in length, wherein the sense strand contains at least one motif of three 2'-F modifications on three consecutive nucleotides at positions 8, 9, and 10 from the 5'end. The antisense strand contains at least one motif of three 2'-O-methyl modifications on three consecutive nucleotides at positions 11, 12, and 13 from the 5'end.

In yet other embodiments, the dsRNAi agent is a double blunt-ended of 21 nucleotides in length, wherein the sense strand contains at least one motif of three 2'-F modifications on three consecutive nucleotides at positions 9, 10, and 11 from the 5'end. The antisense strand contains at least one motif of three 2'-O-methyl modifications on three consecutive nucleotides at positions 11, 12, and 13 from the 5'end.

In certain embodiments, the dsRNAi agent comprises a 21 nucleotide sense strand and a 23 nucleotide antisense strand, wherein the sense strand contains at least one motif of three 2'-F modifications on three consecutive nucleotides at positions 9, 10, and 11 from the 5'end; the antisense strand contains at least one motif of three 2'-O-methyl modifications on three consecutive nucleotides at positions 11, 12, and 13 from the 5'end, wherein one end of the RNAi agent is blunt, while the other end comprises a 2 nucleotide overhang. In one embodiment, the 2 nucleotide overhang is at the 3'-end of the antisense strand.

When the 2 nucleotide overhang is at the 3'-end of the antisense strand, there may be two phosphorothioate internucleotide linkages between the terminal three nucleotides, wherein two of the three nucleotides are the overhang nucleotides, and the third nucleotide is a paired nucleotide next to the overhang nucleotide. In one embodiment, the RNAi agent additionally has two phosphorothioate internucleotide linkages between the terminal three nucleotides at both the 5'-end of the sense strand and at the 5'-end of the antisense strand. In certain embodiments, every nucleotide in the sense strand and the antisense strand of the dsRNAi agent, including the nucleotides that are part of the motifs are modified nucleotides. In certain embodiments each residue is independently modified with a 2'-O-methyl or 3'-fluoro, e.g., in an alternating motif. Optionally, the dsRNAi agent further comprises a ligand (such as, GalNAc$_3$).

In certain embodiments, the dsRNAi agent comprises a sense and an antisense strand, wherein the sense strand is 25-30 nucleotide residues in length, wherein starting from the 5' terminal nucleotide (position 1) positions 1 to 23 of the first strand comprise at least 8 ribonucleotides; the antisense strand is 36-66 nucleotide residues in length and, starting from the 3' terminal nucleotide, comprises at least 8 ribonucleotides in the positions paired with positions 1-23 of sense strand to form a duplex; wherein at least the 3' terminal nucleotide of antisense strand is unpaired with sense strand, and up to 6 consecutive 3' terminal nucleotides are unpaired with sense strand, thereby forming a 3' single stranded overhang of 1-6 nucleotides; wherein the 5' terminus of antisense strand comprises from 10-30 consecutive nucleotides which are unpaired with sense strand, thereby forming a 10-30 nucleotide single stranded 5' overhang; wherein at least the sense strand 5' terminal and 3' terminal nucleotides are base paired with nucleotides of antisense strand when sense and antisense strands are aligned for maximum complementarity, thereby forming a substantially duplexed region between sense and antisense strands; and antisense strand is sufficiently complementary to a target RNA along at least 19 ribonucleotides of antisense strand length to reduce target gene expression when the double stranded nucleic acid is introduced into a mammalian cell; and wherein the sense strand contains at least one motif of three 2'-F modifications on three consecutive nucleotides, where at least one of the motifs occurs at or near the cleavage site. The antisense strand contains at least one motif of three 2'-O-methyl modifications on three consecutive nucleotides at or near the cleavage site.

In certain embodiments, the dsRNAi agent comprises sense and antisense strands, wherein the dsRNAi agent comprises a first strand having a length which is at least 25 and at most 29 nucleotides and a second strand having a length which is at most 30 nucleotides with at least one motif of three 2'-O-methyl modifications on three consecutive nucleotides at position 11, 12, 13 from the 5' end; wherein the 3' end of the first strand and the 5' end of the second strand form a blunt end and the second strand is 1~4 nucleotides longer at its 3' end than the first strand, wherein the duplex region which is at least 25 nucleotides in length, and the second strand is sufficiently complementary to a target mRNA along at least 19 nucleotide of the second strand length to reduce target gene expression when the RNAi agent is introduced into a mammalian cell, and wherein Dicer cleavage of the dsRNAi agent results in an siRNA comprising the 3'-end of the second strand, thereby reducing expression of the target gene in the mammal. Optionally, the dsRNAi agent further comprises a ligand.

In certain embodiments, the sense strand of the dsRNAi agent contains at least one motif of three identical modifications on three consecutive nucleotides, where one of the motifs occurs at the cleavage site in the sense strand.

In certain embodiments, the antisense strand of the dsRNAi agent can also contain at least one motif of three identical modifications on three consecutive nucleotides, where one of the motifs occurs at or near the cleavage site in the antisense strand.

For a dsRNAi agent having a duplex region of 19-23 nucleotides in length, the cleavage site of the antisense strand is typically around the 10, 11, and 12 positions from the 5'-end. Thus the motifs of three identical modifications may occur at the 9, 10, 11 positions; the 10, 11, 12 positions; the 11, 12, 13 positions; the 12, 13, 14 positions; or the 13, 14, 15 positions of the antisense strand, the count starting from the first nucleotide from the 5'-end of the antisense strand, or, the count starting from the first paired nucleotide within the duplex region from the 5'-end of the antisense strand. The cleavage site in the antisense strand may also change according to the length of the duplex region of the dsRNAi agent from the 5'-end.

The sense strand of the dsRNAi agent may contain at least one motif of three identical modifications on three consecutive nucleotides at the cleavage site of the strand; and the antisense strand may have at least one motif of three identical modifications on three consecutive nucleotides at or near the cleavage site of the strand. When the sense strand and the antisense strand form a dsRNA duplex, the sense strand and the antisense strand can be so aligned that one motif of the three nucleotides on the sense strand and one motif of the three nucleotides on the antisense strand have at least one nucleotide overlap, i.e., at least one of the three nucleotides of the motif in the sense strand forms a base pair with at least one of the three nucleotides of the motif in the antisense strand. Alternatively, at least two nucleotides may overlap, or all three nucleotides may overlap.

In some embodiments, the sense strand of the dsRNAi agent may contain more than one motif of three identical modifications on three consecutive nucleotides. The first motif may occur at or near the cleavage site of the strand and the other motifs may be a wing modification. The term "wing modification" herein refers to a motif occurring at another portion of the strand that is separated from the motif at or near the cleavage site of the same strand. The wing modification is either adjacent to the first motif or is separated by at least one or more nucleotides. When the motifs are immediately adjacent to each other then the chemistries of the motifs are distinct from each other, and when the motifs are separated by one or more nucleotide than the chemistries can be the same or different. Two or more wing modifications may be present. For instance, when two wing modifications are present, each wing modification may occur at one end relative to the first motif which is at or near cleavage site or on either side of the lead motif.

Like the sense strand, the antisense strand of the dsRNAi agent may contain more than one motif of three identical modifications on three consecutive nucleotides, with at least one of the motifs occurring at or near the cleavage site of the strand. This antisense strand may also contain one or more wing modifications in an alignment similar to the wing modifications that may be present on the sense strand.

In some embodiments, the wing modification on the sense strand or antisense strand of the dsRNAi agent typically does not include the first one or two terminal nucleotides at the 3'-end, 5'-end, or both ends of the strand.

In other embodiments, the wing modification on the sense strand or antisense strand of the dsRNAi agent typically does not include the first one or two paired nucleotides within the duplex region at the 3'-end, 5'-end, or both ends of the strand.

When the sense strand and the antisense strand of the dsRNAi agent each contain at least one wing modification, the wing modifications may fall on the same end of the duplex region, and have an overlap of one, two, or three nucleotides.

When the sense strand and the antisense strand of the dsRNAi agent each contain at least two wing modifications, the sense strand and the antisense strand can be so aligned that two modifications each from one strand fall on one end of the duplex region, having an overlap of one, two, or three nucleotides; two modifications each from one strand fall on the other end of the duplex region, having an overlap of one, two or three nucleotides; two modifications one strand fall on each side of the lead motif, having an overlap of one, two or three nucleotides in the duplex region.

In some embodiments, every nucleotide in the sense strand and antisense strand of the dsRNAi agent, including the nucleotides that are part of the motifs, may be modified. Each nucleotide may be modified with the same or different modification which can include one or more alteration of one or both of the non-linking phosphate oxygens or of one or more of the linking phosphate oxygens; alteration of a constituent of the ribose sugar, e.g., of the 2'-hydroxyl on the ribose sugar; wholesale replacement of the phosphate moiety with "dephospho" linkers; modification or replacement of a naturally occurring base; and replacement or modification of the ribose-phosphate backbone.

As nucleic acids are polymers of subunits, many of the modifications occur at a position which is repeated within a nucleic acid, e.g., a modification of a base, or a phosphate moiety, or a non-linking O of a phosphate moiety. In some cases the modification will occur at all of the subject positions in the nucleic acid but in many cases it will not. By way of example, a modification may only occur at a 3'- or 5' terminal position, may only occur in a terminal region, e.g., at a position on a terminal nucleotide or in the last 2, 3, 4, 5, or 10 nucleotides of a strand. A modification may occur in a double strand region, a single strand region, or in both. A modification may occur only in the double strand region of an RNA or may only occur in a single strand region of a RNA. For example, a phosphorothioate modification at a non-linking 0 position may only occur at one or both termini, may only occur in a terminal region, e.g., at a position on a terminal nucleotide or in the last 2, 3, 4, 5, or 10 nucleotides of a strand, or may occur in double strand and single strand regions, particularly at termini. The 5'-end or ends can be phosphorylated.

It may be possible, e.g., to enhance stability, to include particular bases in overhangs, or to include modified nucleotides or nucleotide surrogates, in single strand overhangs, e.g., in a 5'- or 3'-overhang, or in both. For example, it can be desirable to include purine nucleotides in overhangs. In some embodiments all or some of the bases in a 3'- or 5'-overhang may be modified, e.g., with a modification described herein. Modifications can include, e.g., the use of modifications at the 2' position of the ribose sugar with modifications that are known in the art, e.g., the use of deoxyribonucleotides, 2'-deoxy-2'-fluoro (2'-F) or 2'-O-methyl modified instead of the ribosugar of the nucleobase, and modifications in the phosphate group, e.g., phosphorothioate modifications. Overhangs need not be homologous with the target sequence.

In some embodiments, each residue of the sense strand and antisense strand is independently modified with LNA, CRN, cET, UNA, HNA, CeNA, 2'-methoxyethyl, 2'-O-methyl, 2'-O-allyl, 2'-C-allyl, 2'-deoxy, 2'-hydroxyl, or 2'-fluoro. The strands can contain more than one modification. In one embodiment, each residue of the sense strand and antisense strand is independently modified with 2'-O-methyl or 2'-fluoro.

At least two different modifications are typically present on the sense strand and antisense strand. Those two modifications may be the 2'-O-methyl or 2'-fluoro modifications, or others. In certain embodiments, the $N_a$ or $N_b$ comprise modifications of an alternating pattern. The term "alternating motif" as used herein refers to a motif having one or more modifications, each modification occurring on alternating nucleotides of one strand. The alternating nucleotide may refer to one per every other nucleotide or one per every three nucleotides, or a similar pattern. For example, if A, B and C each represent one type of modification to the nucleotide, the alternating motif can be "ABABABABABAB . . . ," "AABBAABBAABB . . . ," "AABAABAABAAB . . . ," "AAABAAABAAAB . . . ," "AAABBBAAABBB . . . ," or "ABCABCABCABC . . . ," etc.

The type of modifications contained in the alternating motif may be the same or different. For example, if A, B, C, D each represent one type of modification on the nucleotide, the alternating pattern, i.e., modifications on every other nucleotide, may be the same, but each of the sense strand or antisense strand can be selected from several possibilities of modifications within the alternating motif such as "ABABAB . . . ", "ACACAC . . . " "BDBDBD . . . " or "CDCDCD . . . ," etc.

In some embodiments, the dsRNAi agent of the invention comprises the modification pattern for the alternating motif on the sense strand relative to the modification pattern for the alternating motif on the antisense strand is shifted. The shift may be such that the modified group of nucleotides of the sense strand corresponds to a differently modified group of nucleotides of the antisense strand and vice versa. For example, the sense strand when paired with the antisense strand in the dsRNA duplex, the alternating motif in the sense strand may start with "ABABAB" from 5' to 3' of the strand and the alternating motif in the antisense strand may start with "BABABA" from 5' to 3' of the strand within the duplex region. As another example, the alternating motif in the sense strand may start with "AABBAABB" from 5' to 3' of the strand and the alternating motif in the antisense strand may start with "BBAABBAA" from 5' to 3' of the strand within the duplex region, so that there is a complete or partial shift of the modification patterns between the sense strand and the antisense strand.

In one particular example, the alternating motif in the sense strand is "ABABAB" sfrom 5' 3' of the strand, where each A is an unmodified ribonucleotide and each B is a 2'-Omethyl modified nucleotide.

In one particular example, the alternating motif in the sense strand is "ABABAB" sfrom 5' 3' of the strand, where each A is a 2'-deoxy-2'-fluoro modified nucleotide and each B is a 2'-Omethyl modified nucleotide.

In another particular example, the alternating motif in the antisense strand is "BABABA" from 3'-5' of the strand, where each A is a 2'-deoxy-2'-fluoro modified nucleotide and each B is a 2'-Omethyl modified nucleotide.

In one particular example, the alternating motif in the sense strand is "ABABAB" sfrom 5' 3' of the strand and the alternating motif in the antisense strand is "BABABA" from 3'-5' of the strand, where each A is an unmodified ribonucleotide and each B is a 2'-Omethyl modified nucleotide.

In one particular example, the alternating motif in the sense strand is "ABABAB" sfrom 5' 3' of the strand and the alternating motif in the antisense strand is "BABABA" from 3'-5' of the strand, where each A is a 2'-deoxy-2'-fluoro modified nucleotide and each B is a 2'-Omethyl modified nucleotide.

In some embodiments, the dsRNAi agent comprises the pattern of the alternating motif of 2'-O-methyl modification and 2'-F modification on the sense strand initially has a shift relative to the pattern of the alternating motif of 2'-O-methyl modification and 2'-F modification on the antisense strand initially, i.e., the 2'-O-methyl modified nucleotide on the sense strand base pairs with a 2'-F modified nucleotide on the antisense strand and vice versa. The 1 position of the sense strand may start with the 2'-F modification, and the 1 position of the antisense strand may start with the 2'-O-methyl modification.

The introduction of one or more motifs of three identical modifications on three consecutive nucleotides to the sense strand or antisense strand interrupts the initial modification pattern present in the sense strand or antisense strand. This interruption of the modification pattern of the sense or antisense strand by introducing one or more motifs of three identical modifications on three consecutive nucleotides to the sense or antisense strand may enhance the gene silencing activity against the target gene.

In some embodiments, when the motif of three identical modifications on three consecutive nucleotides is introduced to any of the strands, the modification of the nucleotide next to the motif is a different modification than the modification of the motif. For example, the portion of the sequence containing the motif is " . . . $N_a$YYY$N_b$ . . . ," where "Y" represents the modification of the motif of three identical modifications on three consecutive nucleotide, and "$N_a$" and "$N_b$" represent a modification to the nucleotide next to the motif "YYY" that is different than the modification of Y, and where $N_a$ and $N_b$ can be the same or different modifications. Alternatively, $N_a$ or $N_b$ may be present or absent when there is a wing modification present.

The iRNA may further comprise at least one phosphorothioate or methylphosphonate internucleotide linkage. The phosphorothioate or methylphosphonate internucleotide linkage modification may occur on any nucleotide of the sense strand, antisense strand, or both strands in any position of the strand. For instance, the internucleotide linkage modification may occur on every nucleotide on the sense strand or antisense strand; each internucleotide linkage modification may occur in an alternating pattern on the sense strand or antisense strand; or the sense strand or antisense strand may contain both internucleotide linkage modifications in an alternating pattern. The alternating pattern of the internucleotide linkage modification on the sense strand may be the same or different from the antisense strand, and the alternating pattern of the internucleotide linkage modification on the sense strand may have a shift relative to the alternating pattern of the internucleotide linkage modification on the antisense strand. In one embodiment, a double-stranded RNAi agent comprises 6-8 phosphorothioate internucleotide linkages. In some embodiments, the antisense strand comprises two phosphorothioate internucleotide linkages at the 5'-end and two phosphorothioate internucleotide linkages at the 3'-end, and the sense strand comprises at least two phosphorothioate internucleotide linkages at either the 5'-end or the 3'-end.

In some embodiments, the dsRNAi agent comprises a phosphorothioate or methylphosphonate internucleotide linkage modification in the overhang region. For example, the overhang region may contain two nucleotides having a phosphorothioate or methylphosphonate internucleotide linkage between the two nucleotides. Internucleotide linkage modifications also may be made to link the overhang nucleotides with the terminal paired nucleotides within the duplex region. For example, at least 2, 3, 4, or all the overhang nucleotides may be linked through phosphorothioate or methylphosphonate internucleotide linkage, and optionally, there may be additional phosphorothioate or methylphosphonate internucleotide linkages linking the overhang nucleotide with a paired nucleotide that is next to the overhang nucleotide. For instance, there may be at least two phosphorothioate internucleotide linkages between the terminal three nucleotides, in which two of the three nucleotides are overhang nucleotides, and the third is a paired nucleotide next to the overhang nucleotide. These terminal three nucleotides may be at the 3'-end of the antisense strand, the 3'-end of the sense strand, the 5'-end of the antisense strand, or the 5' end of the antisense strand.

In some embodiments, the 2-nucleotide overhang is at the 3'-end of the antisense strand, and there are two phosphorothioate internucleotide linkages between the terminal three nucleotides, wherein two of the three nucleotides are the overhang nucleotides, and the third nucleotide is a paired nucleotide next to the overhang nucleotide. Optionally, the dsRNAi agent may additionally have two phosphorothioate internucleotide linkages between the terminal three nucleotides at both the 5'-end of the sense strand and at the 5'-end of the antisense strand.

In one embodiment, the dsRNAi agent comprises mismatch(es) with the target, within the duplex, or combinations thereof. The mismatch may occur in the overhang region or the duplex region. The base pair may be ranked on the basis of their propensity to promote dissociation or melting (e.g., on the free energy of association or dissociation of a particular pairing, the simplest approach is to examine the pairs on an individual pair basis, though next neighbor or similar analysis can also be used). In terms of promoting dissociation: A:U is preferred over G:C; G:U is preferred over G:C; and I:C is preferred over G:C (I=inosine). Mismatches, e.g., non-canonical or other than canonical pairings (as described elsewhere herein) are preferred over canonical (A:T, A:U, G:C) pairings; and pairings which include a universal base are preferred over canonical pairings.

In certain embodiments, the dsRNAi agent comprises at least one of the first 1, 2, 3, 4, or 5 base pairs within the duplex regions from the 5'-end of the antisense strand independently selected from the group of: A:U, G:U, I:C, and mismatched pairs, e.g., non-canonical or other than canonical pairings or pairings which include a universal base, to promote the dissociation of the antisense strand at the 5'-end of the duplex.

In certain embodiments, the nucleotide at the 1 position within the duplex region from the 5'-end in the antisense strand is selected from A, dA, dU, U, and dT. Alternatively, at least one of the first 1, 2 or 3 base pair within the duplex region from the 5'-end of the antisense strand is an AU base pair. For example, the first base pair within the duplex region from the 5'-end of the antisense strand is an AU base pair.

In other embodiments, the nucleotide at the 3'-end of the sense strand is deoxythimidine (dT) or the nucleotide at the 3'-end of the antisense strand is deoxythimidine (dT). For example, there is a short sequence of deoxythimidine nucleotides, for example, two dT nucleotides on the 3'-end of the sense, antisense strand, or both strands.

In certain embodiments, the sense strand sequence may be represented by formula (I):

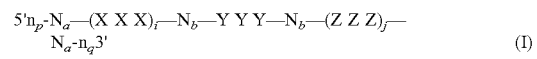

5'$n_p$-$N_a$—(X X X)$_i$—$N_b$—Y Y Y—$N_b$—(Z Z Z)$_j$— $N_a$-$n_q$3'  (I)

wherein:
i and j are each independently 0 or 1;
p and q are each independently 0-6;
each $N_a$ independently represents an oligonucleotide sequence comprising 0-25 modified nucleotides, each sequence comprising at least two differently modified nucleotides;
each $N_b$ independently represents an oligonucleotide sequence comprising 0-10 modified nucleotides;
each $n_p$ and $n_q$ independently represent an overhang nucleotide;
wherein $N_b$ and Y do not have the same modification; and
XXX, YYY, and ZZZ each independently represent one motif of three identical modifications on three consecutive nucleotides. In one embodiment, YYY is all 2'-F modified nucleotides.

In some embodiments, the $N_a$ or $N_b$ comprises modifications of alternating pattern.

In some embodiments, the YYY motif occurs at or near the cleavage site of the sense strand. For example, when the dsRNAi agent has a duplex region of 17-23 nucleotides in length, the YYY motif can occur at or the vicinity of the cleavage site (e.g.: can occur at positions 6, 7, 8; 7, 8, 9; 8, 9, 10; 9, 10, 11; 10, 11, 12; or 11, 12, 13) of the sense strand, the count starting from the first nucleotide, from the 5'-end; or optionally, the count starting at the first paired nucleotide within the duplex region, from the 5'-end.

In one embodiment, i is 1 and j is 0, or i is 0 and j is 1, or both i and j are 1. The sense strand can therefore be represented by the following formulas:

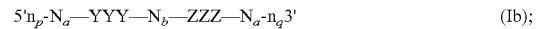

5'$n_p$-$N_a$—YYY—$N_b$—ZZZ—$N_a$-$n_q$3'  (Ib);

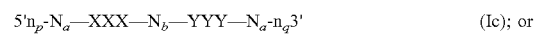

5'$n_p$-$N_a$—XXX—$N_b$—YYY—$N_a$-$n_q$3'  (Ic); or

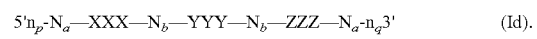

5'$n_p$-$N_a$—XXX—$N_b$—YYY—$N_b$—ZZZ—$N_a$-$n_q$3'  (Id).

When the sense strand is represented by formula (Ib), $N_b$ represents an oligonucleotide sequence comprising 0-10, 0-7, 0-5, 0-4, 0-2, or 0 modified nucleotides. Each $N_a$ independently can represent an oligonucleotide sequence comprising 2-20, 2-15, or 2-10 modified nucleotides.

When the sense strand is represented as formula (Ic), $N_b$ represents an oligonucleotide sequence comprising 0-10, 0-7, 0-10, 0-7, 0-5, 0-4, 0-2, or 0 modified nucleotides. Each $N_a$ can independently represent an oligonucleotide sequence comprising 2-20, 2-15, or 2-10 modified nucleotides.

When the sense strand is represented as formula (Id), each $N_b$ independently represents an oligonucleotide sequence comprising 0-10, 0-7, 0-5, 0-4, 0-2, or 0 modified nucleotides. In one embodiment, $N_b$ is 0, 1, 2, 3, 4, 5, or 6 Each $N_a$ can independently represent an oligonucleotide sequence comprising 2-20, 2-15, or 2-10 modified nucleotides.

Each of X, Y and Z may be the same or different from each other.

In other embodiments, i is 0 and j is 0, and the sense strand may be represented by the formula:

When the sense strand is represented by formula (Ia), each $N_a$ independently can represent an oligonucleotide sequence comprising 2-20, 2-15, or 2-10 modified nucleotides.

In one embodiment, the antisense strand sequence of the RNAi may be represented by formula (II):

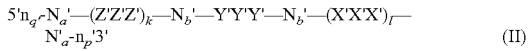

wherein:
k and l are each independently 0 or 1;
p' and q' are each independently 0-6;
each $N_a'$ independently represents an oligonucleotide sequence comprising 0-25 modified nucleotides, each sequence comprising at least two differently modified nucleotides;
each $N_b'$ independently represents an oligonucleotide sequence comprising 0-10 modified nucleotides;
each $n_p'$ and $n_q'$ independently represent an overhang nucleotide;
wherein $N_b'$ and Y' do not have the same modification; and
X'X'X', Y'Y'Y', and Z'Z'Z' each independently represent one motif of three identical modifications on three consecutive nucleotides.

In some embodiments, the $N_a'$ or $N_b'$ comprises modifications of alternating pattern.

The Y'Y'Y' motif occurs at or near the cleavage site of the antisense strand. For example, when the dsRNAi agent has a duplex region of 17-23 nucleotides in length, the Y'Y'Y' motif can occur at positions 9, 10, 11; 10, 11, 12; 11, 12, 13; 12, 13, 14; or 13, 14, 15 of the antisense strand, with the count starting from the first nucleotide, from the 5'-end; or optionally, the count starting at the first paired nucleotide within the duplex region, from the 5'-end. In one embodiment, the Y'Y'Y' motif occurs at positions 11, 12, 13.

In certain embodiments, Y'Y'Y' motif is all 2'-OMe modified nucleotides.

In certain embodiments, k is 1 and l is 0, or k is 0 and l is 1, or both k and l are 1. The antisense strand can therefore be represented by the following formulas:

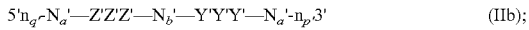

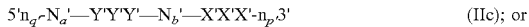

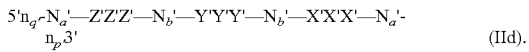

When the antisense strand is represented by formula (IIb), $N_b'$ represents an oligonucleotide sequence comprising 0-10, 0-7, 0-10, 0-7, 0-5, 0-4, 0-2, or 0 modified nucleotides. Each $N_a'$ independently represents an oligonucleotide sequence comprising 2-20, 2-15, or 2-10 modified nucleotides.

When the antisense strand is represented as formula (IIc), $N_b'$ represents an oligonucleotide sequence comprising 0-10, 0-7, 0-10, 0-7, 0-5, 0-4, 0-2, or 0 modified nucleotides. Each $N_a'$ independently represents an oligonucleotide sequence comprising 2-20, 2-15, or 2-10 modified nucleotides.

When the antisense strand is represented as formula (IId), each $N_b'$ independently represents an oligonucleotide sequence comprising 0-10, 0-7, 0-10, 0-7, 0-5, 0-4, 0-2, or 0 modified nucleotides. Each $N_a'$ independently represents an oligonucleotide sequence comprising 2-20, 2-15, or 2-10 modified nucleotides. In one embodiment, $N_b$ is 0, 1, 2, 3, 4, 5, or 6.

In other embodiments, k is 0 and l is 0 and the antisense strand may be represented by the formula:

When the antisense strand is represented as formula (IIa), each $N_a'$ independently represents an oligonucleotide sequence comprising 2-20, 2-15, or 2-10 modified nucleotides.

Each of X', Y' and Z' may be the same or different from each other.

Each nucleotide of the sense strand and antisense strand may be independently modified with LNA, CRN, UNA, cEt, HNA, CeNA, 2'-methoxyethyl, 2'-O-methyl, 2'-O-allyl, 2'-C-allyl, 2'-hydroxyl, or 2'-fluoro. For example, each nucleotide of the sense strand and antisense strand is independently modified with 2'-O-methyl or 2'-fluoro. Each X, Y, Z, X', Y', and Z', in particular, may represent a 2'-O-methyl modification or a 2'-fluoro modification.

In some embodiments, the sense strand of the dsRNAi agent may contain YYY motif occurring at 9, 10, and 11 positions of the strand when the duplex region is 21 nt, the count starting from the first nucleotide from the 5'-end, or optionally, the count starting at the first paired nucleotide within the duplex region, from the 5'-end; and Y represents 2'-F modification. The sense strand may additionally contain XXX motif or ZZZ motifs as wing modifications at the opposite end of the duplex region; and XXX and ZZZ each independently represents a 2'-OMe modification or 2'-F modification.

In some embodiments the antisense strand may contain Y'Y'Y' motif occurring at positions 11, 12, 13 of the strand, the count starting from the first nucleotide from the 5'-end, or optionally, the count starting at the first paired nucleotide within the duplex region, from the 5'-end; and Y' represents 2'-O-methyl modification. The antisense strand may additionally contain X'X'X' motif or Z'Z'Z' motifs as wing modifications at the opposite end of the duplex region; and X'X'X' and Z'Z'Z' each independently represents a 2'-OMe modification or 2'-F modification.

The sense strand represented by any one of the above formulas (Ia), (Ib), (Ic), and (Id) forms a duplex with an antisense strand being represented by any one of formulas (IIa), (IIb), (IIc), and (IId), respectively.

Accordingly, the dsRNAi agents for use in the methods of the invention may comprise a sense strand and an antisense strand, each strand having 14 to 30 nucleotides, the iRNA duplex represented by formula (III):

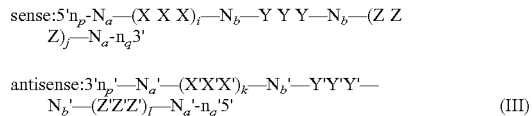

wherein:
j, k, and l are each independently 0 or 1;
p, p', q, and q' are each independently 0-6;
each $N_a$ and $N_a'$ independently represents an oligonucleotide sequence comprising 0-25 modified nucleotides, each sequence comprising at least two differently modified nucleotides;
each $N_b$ and $N_b'$ independently represents an oligonucleotide sequence comprising 0-10 modified nucleotides;
wherein each $n_p'$, $n_p$, $n_q'$, and $n_q$, each of which may or may not be present, independently represents an overhang nucleotide; and
XXX, YYY, ZZZ, X'X'X', Y'Y'Y', and Z'Z'Z' each independently represent one motif of three identical modifications on three consecutive nucleotides.

In one embodiment, i is 0 and j is 0; or i is 1 and j is 0; or i is 0 and j is 1; or both i and j are 0; or both i and j are 1. In another embodiment, k is 0 and l is 0; or k is 1 and l is 0; k is 0 and l is 1; or both k and I are 0; or both k and I are 1.

Exemplary combinations of the sense strand and antisense strand forming an iRNA duplex include the formulas below:

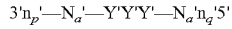   (IIIa)

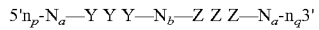

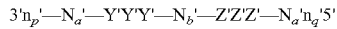   (IIIb)

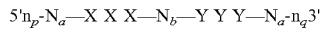

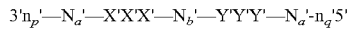   (IIIc)

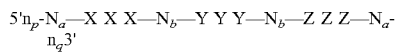

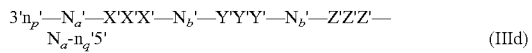   (IIId)

When the dsRNAi agent is represented by formula (IIIa), each $N_a$ independently represents an oligonucleotide sequence comprising 2-20, 2-15, or 2-10 modified nucleotides.

When the dsRNAi agent is represented by formula (IIIb), each $N_b$ independently represents an oligonucleotide sequence comprising 1-10, 1-7, 1-5, or 1-4 modified nucleotides. Each N a independently represents an oligonucleotide sequence comprising 2-20, 2-15, or 2-10 modified nucleotides.

When the dsRNAi agent is represented as formula (IIIc), each $N_b$, $N_b'$ independently represents an oligonucleotide sequence comprising 0-10, 0-7, 0-10, 0-7, 0-5, 0-4, 0-2, or 0 modified nucleotides. Each $N_a$ independently represents an oligonucleotide sequence comprising 2-20, 2-15, or 2-10 modified nucleotides.

When the dsRNAi agent is represented as formula (IIId), each $N_b$, $N_b'$ independently represents an oligonucleotide sequence comprising 0-10, 0-7, 0-10, 0-7, 0-5, 0-4, 0-2, or 0 modified nucleotides. Each $N_a$, $N_a'$ independently represents an oligonucleotide sequence comprising 2-20, 2-15, or 2-10 modified nucleotides. Each of $N_a$, $N_a'$, $N_b$, and $N_b'$ independently comprises modifications of alternating pattern.

Each of X, Y, and Z in formulas (III), (IIIa), (IIIb), (IIIc), and (IIId) may be the same or different from each other.

When the dsRNAi agent is represented by formula (III), (IIIa), (IIIb), (IIIc), and (IIId), at least one of the Y nucleotides may form a base pair with one of the Y' nucleotides. Alternatively, at least two of the Y nucleotides form base pairs with the corresponding Y' nucleotides; or all three of the Y nucleotides all form base pairs with the corresponding Y' nucleotides.

When the dsRNAi agent is represented by formula (IIIb) or (IIId), at least one of the Z nucleotides may form a base pair with one of the Z' nucleotides. Alternatively, at least two of the Z nucleotides form base pairs with the corresponding Z' nucleotides; or all three of the Z nucleotides all form base pairs with the corresponding Z' nucleotides.

When the dsRNAi agent is represented as formula (IIIc) or (IIId), at least one of the X nucleotides may form a base pair with one of the X' nucleotides. Alternatively, at least two of the X nucleotides form base pairs with the corresponding X' nucleotides; or all three of the X nucleotides all form base pairs with the corresponding X' nucleotides.

In certain embodiments, the modification on the Y nucleotide is different than the modification on the Y' nucleotide, the modification on the Z nucleotide is different than the modification on the Z' nucleotide, or the modification on the X nucleotide is different than the modification on the X' nucleotide.

In certain embodiments, when the dsRNAi agent is represented by formula (IIId), the N a modifications are 2'-O-methyl or 2'-fluoro modifications. In other embodiments, when the RNAi agent is represented by formula (IIId), the $N_a$ modifications are 2'-O-methyl or 2'-fluoro modifications and $n_p'>0$ and at least one $n_p'$ is linked to a neighboring nucleotide a via phosphorothioate linkage. In yet other embodiments, when the RNAi agent is represented by formula (IIId), the $N_a$ modifications are 2'-O-methyl or 2'-fluoro modifications, $n_p'>0$ and at least one $n_p'$ is linked to a neighboring nucleotide via phosphorothioate linkage, and the sense strand is conjugated to one or more GalNAc derivatives attached through a bivalent or trivalent branched linker (described below). In other embodiments, when the RNAi agent is represented by formula (IIId), the $N_a$ modifications are 2'-O-methyl or 2'-fluoro modifications, $n_p'>0$ and at least one $n_p'$ is linked to a neighboring nucleotide via phosphorothioate linkage, the sense strand comprises at least one phosphorothioate linkage, and the sense strand is conjugated to one or more GalNAc derivatives attached through a bivalent or trivalent branched linker.

In some embodiments, when the dsRNAi agent is represented by formula (IIIa), the N a modifications are 2'-O-methyl or 2'-fluoro modifications, $n_p'>0$ and at least one $n_p'$ is linked to a neighboring nucleotide via phosphorothioate linkage, the sense strand comprises at least one phosphorothioate linkage, and the sense strand is conjugated to one or more GalNAc derivatives attached through a bivalent or trivalent branched linker.

In some embodiments, the dsRNAi agent is a multimer containing at least two duplexes represented by formula (III), (IIIa), (IIIb), (IIIc), and (IIId), wherein the duplexes are connected by a linker. The linker can be cleavable or non-cleavable. Optionally, the multimer further comprises a ligand. Each of the duplexes can target the same gene or two different genes; or each of the duplexes can target same gene at two different target sites.

In some embodiments, the dsRNAi agent is a multimer containing three, four, five, six, or more duplexes represented by formula (III), (IIIa), (IIIb), (IIIc), and (IIId), wherein the duplexes are connected by a linker. The linker can be cleavable or non-cleavable. Optionally, the multimer further comprises a ligand. Each of the duplexes can target the same gene or two different genes; or each of the duplexes can target same gene at two different target sites.

In one embodiment, two dsRNAi agents represented by at least one of formulas (III), (IIIa), (IIIb), (IIIc), and (IIId) are linked to each other at the 5' end, and one or both of the 3' ends, and are optionally conjugated to a ligand. Each of the agents can target the same gene or two different genes; or each of the agents can target same gene at two different target sites.

In certain embodiments, an RNAi agent of the invention may contain a low number of nucleotides containing a 2'-fluoro modification, e.g., 10 or fewer nucleotides with 2'-fluoro modification. For example, the RNAi agent may contain 10, 9, 8, 7, 6, 5, 4, 3, 2, 1 or 0 nucleotides with a 2'-fluoro modification. In a specific embodiment, the RNAi agent of the invention contains 10 nucleotides with a 2'-fluoro modification, e.g., 4 nucleotides with a 2'-fluoro modification in the sense strand and 6 nucleotides with a 2'-fluoro modification in the antisense strand. In another specific embodiment, the RNAi agent of the invention contains 6 nucleotides with a 2'-fluoro modification, e.g., 4 nucleotides with a 2'-fluoro modification in the sense strand and 2 nucleotides with a 2'-fluoro modification in the antisense strand.

In other embodiments, an RNAi agent of the invention may contain an ultra low number of nucleotides containing a 2'-fluoro modification, e.g., 2 or fewer nucleotides containing a 2'-fluoro modification. For example, the RNAi agent may contain 2, 1 of 0 nucleotides with a 2'-fluoro modification. In a specific embodiment, the RNAi agent may contain 2 nucleotides with a 2'-fluoro modification, e.g., 0 nucleotides with a 2-fluoro modification in the sense strand and 2 nucleotides with a 2'-fluoro modification in the antisense strand.

Various publications describe multimeric iRNAs that can be used in the methods of the invention. Such publications include WO2007/091269, U.S. Pat. No. 7,858,769, WO2010/141511, WO2007/117686, WO2009/014887, and WO2011/031520 the entire contents of each of which are hereby incorporated herein by reference.

In certain embodiments, the compositions and methods of the disclosure include a vinyl phosphonate (VP) modification of an RNAi agent as described herein. In exemplary embodiments, a 5'-vinyl phosphonate modified nucleotide of the disclosure has the structure:

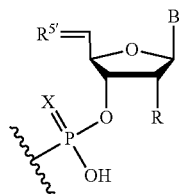

wherein X is O or S;
R is hydrogen, hydroxy, fluoro, or $C_{1-20}$ alkoxy (e.g., methoxy or n-hexadecyloxy);
$R^{5'}$ is =C(H)—P(O)(OH)$_2$ and the double bond between the C5' carbon and R5' is in the E or Z orientation (e.g., E orientation); and
B is a nucleobase or a modified nucleobase, optionally where B is adenine, guanine, cytosine, thymine, or uracil.

In one embodiment, $R^{5'}$ is =C(H)—P(O)(OH)$_2$ and the double bond between the C5' carbon and R5' is in the E orientation. In another embodiment, R is methoxy and $R^{5'}$ is =C(H)—P(O)(OH)$_2$ and the double bond between the C5' carbon and R5' is in the E orientation. In another embodiment, X is S, R is methoxy, and $R^{5'}$ is =C(H)—P(O)(OH)$_2$ and the double bond between the C5' carbon and R5' is in the E orientation.

A vinyl phosphonate of the instant disclosure may be attached to either the antisense or the sense strand of a dsRNA of the disclosure. In certain embodiments, a vinyl phosphonate of the instant disclosure is attached to the antisense strand of a dsRNA, optionally at the 5' end of the antisense strand of the dsRNA.

Vinyl phosphonate modifications are also contemplated for the compositions and methods of the instant disclosure. An exemplary vinyl phosphonate structure includes the preceding structure, where R5' is =C(H)—OP(O)(OH)2 and the double bond between the C5' carbon and R5' is in the E or Z orientation (e.g., E orientation).

As described in more detail below, the iRNA that contains conjugations of one or more carbohydrate moieties to an iRNA can optimize one or more properties of the iRNA. In many cases, the carbohydrate moiety will be attached to a modified subunit of the iRNA. For example, the ribose sugar of one or more ribonucleotide subunits of a iRNA can be replaced with another moiety, e.g., a non-carbohydrate (such as, cyclic) carrier to which is attached a carbohydrate ligand. A ribonucleotide subunit in which the ribose sugar of the subunit has been so replaced is referred to herein as a ribose replacement modification subunit (RRMS). A cyclic carrier may be a carbocyclic ring system, i.e., all ring atoms are carbon atoms, or a heterocyclic ring system, i.e., one or more ring atoms may be a heteroatom, e.g., nitrogen, oxygen, sulfur. The cyclic carrier may be a monocyclic ring system, or may contain two or more rings, e.g. fused rings. The cyclic carrier may be a fully saturated ring system, or it may contain one or more double bonds.

The ligand may be attached to the polynucleotide via a carrier. The carriers include (i) at least one "backbone attachment point," such as, two "backbone attachment points" and (ii) at least one "tethering attachment point." A "backbone attachment point" as used herein refers to a functional group, e.g. a hydroxyl group, or generally, a bond available for, and that is suitable for incorporation of the carrier into the backbone, e.g., the phosphate, or modified phosphate, e.g., sulfur containing, backbone, of a ribonucleic acid. A "tethering attachment point" (TAP) in some embodiments refers to a constituent ring atom of the cyclic carrier, e.g., a carbon atom or a heteroatom (distinct from an atom which provides a backbone attachment point), that connects a selected moiety. The moiety can be, e.g., a carbohydrate, e.g. monosaccharide, disaccharide, trisaccharide, tetrasaccharide, oligosaccharide, or polysaccharide. Optionally, the selected moiety is connected by an intervening tether to the cyclic carrier. Thus, the cyclic carrier will often include a functional group, e.g., an amino group, or generally, provide a bond, that is suitable for incorporation or tethering of another chemical entity, e.g., a ligand to the constituent ring.

The iRNA may be conjugated to a ligand via a carrier, wherein the carrier can be cyclic group or acyclic group. In one embodiment, the cyclic group is selected from pyrrolidinyl, pyrazolinyl, pyrazolidinyl, imidazolinyl, imidazolidinyl, piperidinyl, piperazinyl, [1,3]dioxolane, oxazolidinyl, isoxazolidinyl, morpholinyl, thiazolidinyl, isothiazolidinyl, quinoxalinyl, pyridazinonyl, tetrahydrofuryl, and decalin. In one embodiment, the acyclic group is a serinol backbone or diethanolamine backbone.

i. Thermally Destabilizing Modifications

In certain embodiments, a dsRNA molecule can be optimized for RNA interference by incorporating thermally destabilizing modifications in the seed region of the antisense strand (i.e., at positions 2-9 of the 5'-end of the antisense strand or at positions 2-8 of the 5'-end of the antisense strand) to reduce or inhibit off-target gene silencing.

The term "thermally destabilizing modification(s)" includes modification(s) that would result with a dsRNA with a lower overall melting temperature (T m) than the T m of the dsRNA without having such modification(s). For example, the thermally destabilizing modification(s) can decrease the T m of the dsRNA by 1-4° C., such as one, two, three or four degrees Celcius. And, the term "thermally destabilizing nucleotide" refers to a nucleotide containing one or more thermally destabilizing modifications.

It has been discovered that dsRNAs with an antisense strand comprising at least one thermally destabilizing modification of the duplex within the first 9 nucleotide positions, counting from the 5' end, of the antisense strand have reduced off-target gene silencing activity. Accordingly, in some embodiments, the antisense strand comprises at least one (e.g., one, two, three, four, five or more) thermally destabilizing modification of the duplex within the first 9 nucleotide positions of the 5' region of the antisense strand. In some embodiments, one or more thermally destabilizing modification(s) of the duplex is/are located in positions 2-9, such as, positions 4-8, from the 5'-end of the antisense strand. In some further embodiments, the thermally destabilizing modification(s) of the duplex is/are located at position 6, 7 or 8 from the 5'-end of the antisense strand. In still some further embodiments, the thermally destabilizing modification of the duplex is located at position 7 from the 5'-end of the antisense strand. In some embodiments, the thermally destabilizing modification of the duplex is located at position 2, 3, 4, 5 or 9 from the 5'-end of the antisense strand.

An iRNA agent comprises a sense strand and an antisense strand, each strand having 14 to 40 nucleotides. The RNAi agent may be represented by formula (L):

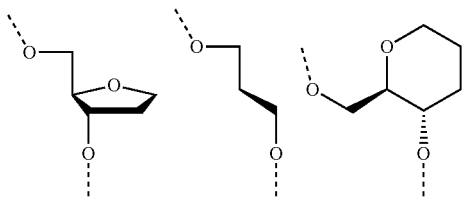

and iii) sugar modification selected from the group consisting of:

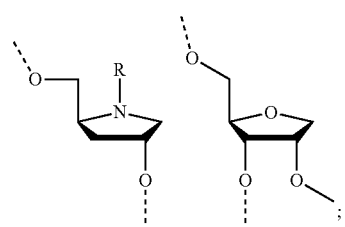

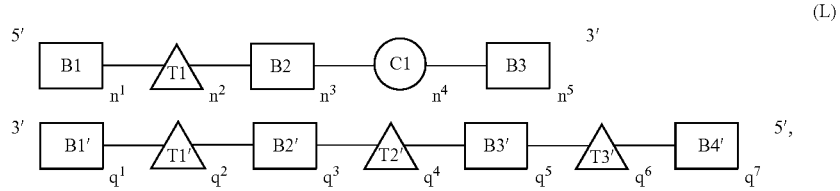

(L)

In formula (L), B1, B2, B3, B1', B2', B3', and B4' each are independently a nucleotide containing a modification selected from the group consisting of 2'-O-alkyl, 2'-substituted alkoxy, 2'-substituted alkyl, 2'-halo, ENA, and BNA/LNA. In one embodiment, B1, B2, B3, B1', B2', B3', and B4' each contain 2'-OMe modifications. In one embodiment, B1, B2, B3, B1', B2', B3', and B4' each contain 2'-OMe or 2'-F modifications. In one embodiment, at least one of B1, B2, B3, B1', B2', B3', and B4' contain 2'-O—N-methylacetamido (2'-O-NMA, 2'O—CH$_2$C(O)N(Me)H) modification.

C1 is a thermally destabilizing nucleotide placed at a site opposite to the seed region of the antisense strand (i.e., at positions 2-8 of the 5'-end of the antisense strand or at positions 2-9 of the 5'-end of the antisense strand). For example, C1 is at a position of the sense strand that pairs with a nucleotide at positions 2-8 of the 5'-end of the antisense strand. In one example, C1 is at position 15 from the 5'-end of the sense strand. $C_1$ nucleotide bears the thermally destabilizing modification which can include abasic modification; mismatch with the opposing nucleotide in the duplex; and sugar modification such as 2'-deoxy modification or acyclic nucleotide e.g., unlocked nucleic acids (UNA) or glycerol nucleic acid (GNA). In one embodiment, C1 has thermally destabilizing modification selected from the group consisting of: i) mismatch with the opposing nucleotide in the antisense strand; ii) abasic modification selected from the group consisting of:

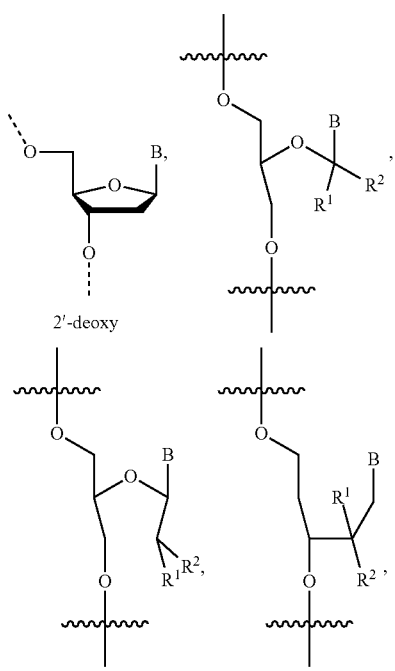

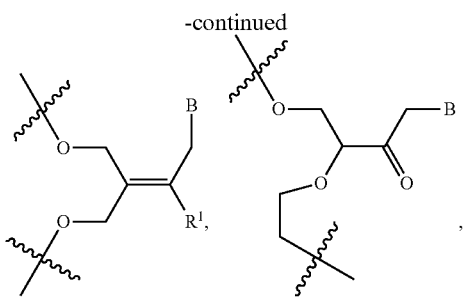

and

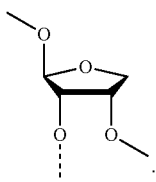

wherein B is a modified or unmodified nucleobase, $R^1$ and $R^2$ independently are H, halogen, OR 3, or alkyl; and R3 is H, alkyl, cycloalkyl, aryl, aralkyl, heteroaryl or sugar. In one embodiment, the thermally destabilizing modification in C1 is a mismatch selected from the group consisting of G:G, G:A, G:U, G:T, A:A, A:C, C:C, C:U, C:T, U:U, T:T, and U:T; and optionally, at least one nucleobase in the mismatch pair is a 2'-deoxy nucleobase. In one example, the thermally destabilizing modification in C1 is GNA or

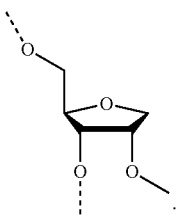

T1, T1', T2', and T3' each independently represent a nucleotide comprising a modification providing the nucleotide a steric bulk that is less or equal to the steric bulk of a 2'-OMe modification. A steric bulk refers to the sum of steric effects of a modification. Methods for determining steric effects of a modification of a nucleotide are known to one skilled in the art. The modification can be at the 2' position of a ribose sugar of the nucleotide, or a modification to a non-ribose nucleotide, acyclic nucleotide, or the backbone of the nucleotide that is similar or equivalent to the 2' position of the ribose sugar, and provides the nucleotide a steric bulk that is less than or equal to the steric bulk of a 2'-OMe modification. For example, T1, T1', T2', and T3' are each independently selected from DNA, RNA, LNA, 2'-F, and 2'-F-5'-methyl. In one embodiment, T1 is DNA. In one embodiment, Ti' is DNA, RNA or LNA. In one embodiment, T2' is DNA or RNA. In one embodiment, T3' is DNA or RNA.

$n^1$, $n^3$, and $q^1$ are independently 4 to 15 nucleotides in length.

$n^5$, $q^3$, and $q^7$ are independently 1-6 nucleotide(s) in length. $n^4$, $q^2$, and $q^6$ are independently 1-3 nucleotide(s) in length; alternatively, $n^4$ is 0.

$q^5$ is independently 0-10 nucleotide(s) in length.

$n^2$ and $q^4$ are independently 0-3 nucleotide(s) in length.

Alternatively, $n^4$ is 0-3 nucleotide(s) in length.

In one embodiment, $n^4$ can be 0. In one example, $n^4$ is 0, and $q^2$ and $q^6$ are 1. In another example, $n^4$ is 0, and $q^2$ and $q^6$ are 1, with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand).

In one embodiment, $n^4$, $q^2$, and $q^6$ are each 1.

In one embodiment, $n^2$, $n^4$, $q^2$, se, and $q^6$ are each 1.

In one embodiment, C1 is at position 14-17 of the 5'-end of the sense strand, when the sense strand is 19-22 nucleotides in length, and $n^4$ is 1. In one embodiment, C1 is at position 15 of the 5'-end of the sense strand In one embodiment, T3' starts at position 2 from the 5' end of the antisense strand. In one example, T3' is at position 2 from the 5' end of the antisense strand and $q^6$ is equal to 1.

In one embodiment, T1' starts at position 14 from the 5' end of the antisense strand. In one example, T1' is at position 14 from the 5' end of the antisense strand and $q^2$ is equal to 1.

In an exemplary embodiment, T3' starts from position 2 from the 5' end of the antisense strand and T1' starts from position 14 from the 5' end of the antisense strand. In one example, T3' starts from position 2 from the 5' end of the antisense strand and $q^6$ is equal to 1 and T1' starts from position 14 from the 5' end of the antisense strand and $q^2$ is equal to 1.

In one embodiment, T1' and T3' are separated by 11 nucleotides in length (i.e. not counting the T1' and T3' nucleotides).

In one embodiment, T1' is at position 14 from the 5' end of the antisense strand. In one example, T1' is at position 14 from the 5' end of the antisense strand and $q^2$ is equal to 1, and the modification at the 2' position or positions in a non-ribose, acyclic or backbone that provide less steric bulk than a 2'-OMe ribose.

In one embodiment, T3' is at position 2 from the 5' end of the antisense strand. In one example, T3' is at position 2 from the 5' end of the antisense strand and $q^6$ is equal to 1, and the modification at the 2' position or positions in a non-ribose, acyclic or backbone that provide less than or equal to steric bulk than a 2'-OMe ribose.

In one embodiment, T1 is at the cleavage site of the sense strand. In one example, T1 is at position 11 from the 5' end of the sense strand, when the sense strand is 19-22 nucleotides in length, and $n^2$ is 1. In an exemplary embodiment, T1 is at the cleavage site of the sense strand at position 11 from the 5' end of the sense strand, when the sense strand is 19-22 nucleotides in length, and $n^2$ is 1, In one embodiment, T2' starts at position 6 from the 5' end of the antisense strand. In one example, T2' is at positions 6-10 from the 5' end of the antisense strand, and $q^4$ is 1.

In an exemplary embodiment, T1 is at the cleavage site of the sense strand, for instance, at position 11 from the 5' end of the sense strand, when the sense strand is 19-22 nucleotides in length, and $n^2$ is 1; T1' is at position 14 from the 5' end of the antisense strand, and $q^2$ is equal to 1, and the modification to T1' is at the 2' position of a ribose sugar or at positions in a non-ribose, acyclic or backbone that provide less steric bulk than a 2'-OMe ribose; T2' is at positions 6-10 from the 5' end of the antisense strand, and $q^4$ is 1; and T3' is at position 2 from the 5' end of the antisense strand, and $q^6$ is equal to 1, and the modification to T3' is at the 2' position or at positions in a non-ribose, acyclic or backbone that provide less than or equal to steric bulk than a 2'-OMe ribose.

In one embodiment, T2' starts at position 8 from the 5' end of the antisense strand. In one example, T2' starts at position 8 from the 5' end of the antisense strand, and $q^4$ is 2.

In one embodiment, T2' starts at position 9 from the 5' end of the antisense strand. In one example, T2' is at position 9 from the 5' end of the antisense strand, and $q^4$ is 1.

In one embodiment, BF is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 1, B3' is 2'-OMe or 2'-F, $q^5$ is 6, T3' is 2'-F, $q^6$ is 1, B4' is 2'-OMe, and $q^7$ is 1; with two phosphorothioate internucleotide linkage modifications within positions 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand).

In one embodiment, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 1, B3' is 2'-OMe or 2'-F, $q^5$ is 6, T3' is 2'-F, $q^6$ is 1, B4' is 2'-OMe, and $q^7$ is 1; with two phosphorothioate internucleotide linkage modifications within positions 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand).

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, BF is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within positions 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand).

In one embodiment, B1 is 2'-OMe or 2'-F, $n^1$ is 6, T1 is 2'F, $n^2$ is 3, B2 is 2'-OMe, $n^3$ is 7, $n^4$ is 0, B3 is 2'OMe, $n^5$ is 3, BF is 2'-OMe or 2'-F, $q^1$ is 7, T1' is 2'-F, $q^2$ is 1, B2' is 2'-OMe or 2'- F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1.

In one embodiment, B1 is 2'-OMe or 2'-F, $n^1$ is 6, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 7, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within positions 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand).

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, BF is 2'-OMe or 2'-F, $q^1$ is 9, T1' is 2'-F, $q^2$ is 1, B2' is 2'-OMe or 2'- F, $q^3$ is 4, T2' is 2'-F, $q^4$ is 1, B3' is 2'-OMe or 2'-F, $q^5$ is 6, T3' is 2'-F, $q^6$ is 1, B4' is 2'-OMe, and $q^7$ is 1.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'- F, $q^3$ is 4, T2' is 2'-F, $q^4$ is 1, B3' is 2'-OMe or 2'-F, $q^5$ is 6, T3' is 2'-F, $q^6$ is 1, B4' is 2'-OMe, and $q^7$ is 1; with two phosphorothioate internucleotide linkage modifications within positions 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand).

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, BF is 2'-OMe or 2'-F, $q^1$ is 9, T1' is 2'-F, $q^2$ is 1, B2' is 2'-OMe or 2'- F, $q^3$ is 5, T2' is 2'-F, $q^4$ is 1, B3' is 2'-OMe or 2'-F, $q^5$ is 5, T3' is 2'-F, $q^6$ is 1, B4' is 2'-OMe, and $q^7$ is 1; optionally with at least 2 additional TT at the 3'-end of the antisense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, BF is 2'-OMe or 2'-F, $q^1$ is 9, T1' is 2'-F, $q^2$ is 1, B2' is 2'-OMe or 2'-F, $q^3$ is 5, T2' is 2'-F, $q^4$ is 1, B3' is 2'-OMe or 2'-F, $q^5$ is 5, T3' is 2'-F, $q^6$ is 1, B4' is 2'-OMe, and $q^7$ is 1; optionally with at least 2 additional TT at the 3'-end of the antisense strand; with two phosphorothioate internucleotide linkage modifications within positions 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand).

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'- F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within positions 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end).

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'- F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within positions 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand).

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'- F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within positions 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand).

The RNAi agent can comprise a phosphorus-containing group at the 5'-end of the sense strand or antisense strand. The 5'-end phosphorus-containing group can be 5'-end phosphate (5'-P), 5'-end phosphorothioate (5'-PS), 5'-end phosphorodithioate (5'-PS 2), 5'-end vinylphosphonate (5'-VP), 5'-end methylphosphonate (MePhos), or 5'-deoxy-5'-C-malonyl

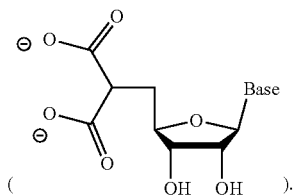

When the 5'-end phosphorus-containing group is 5'-end vinylphosphonate (5'-VP), the 5'-VP can be either 5'-E-VP isomer (i.e., trans-vinylphosphonate,)

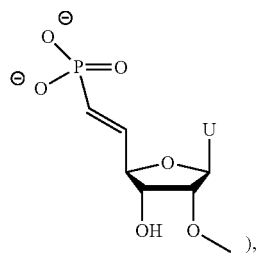

5'-Z—VP isomer (i.e., cis-vinylphosphonate,

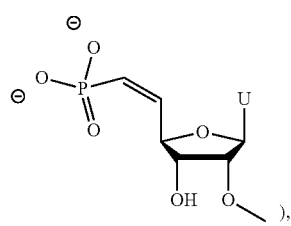

or mixtures thereof.

In one embodiment, the RNAi agent comprises a phosphorus-containing group at the 5'-end of the sense strand. In one embodiment, the RNAi agent comprises a phosphorus-containing group at the 5'-end of the antisense strand.

In one embodiment, the RNAi agent comprises a 5'-P. In one embodiment, the RNAi agent comprises a 5'-P in the antisense strand.

In one embodiment, the RNAi agent comprises a 5'-PS. In one embodiment, the RNAi agent comprises a 5'-PS in the antisense strand.

In one embodiment, the RNAi agent comprises a 5'-VP. In one embodiment, the RNAi agent comprises a 5'-VP in the antisense strand. In one embodiment, the RNAi agent comprises a 5'-E-VP in the antisense strand. In one embodiment, the RNAi agent comprises a 5'-Z—VP in the antisense strand.

In one embodiment, the RNAi agent comprises a 5'-PS2 In one embodiment, the RNAi agent comprises a 5'-PS 2 in the antisense strand.

In one embodiment, the RNAi agent comprises a 5'-PS2 In one embodiment, the RNAi agent comprises a 5'-deoxy-5'-C-malonyl in the antisense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, BF is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1. The RNAi agent also comprises a 5'-PS.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, BF is 2'-OMe or 2'-F, $q^1$ is 9, T1' is 2'-F, $q^2$ is 1, B2' is 2'-OMe or 2'- F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1. The RNAi agent also comprises a 5'-P.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, BF is 2'-OMe or 2'-F, $q^1$ is 9, T1' is 2'-F, $q^2$ is 1, B2' is 2'-OMe or 2'- F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1. The RNAi agent also comprises a 5'-VP. The 5'-VP may be 5'-E-VP, 5'-Z—VP, or combination thereof.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, BF is 2'-OMe or 2'-F, $q^1$ is 9, T1' is 2'-F, $q^2$ is 1, B2' is 2'-OMe or 2'- F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1. The RNAi agent also comprises a 5'-PS2.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, BF is 2'-OMe or 2'-F, $q^1$ is 9, T1' is 2'-F, $q^2$ is 1, B2' is 2'-OMe or 2'- F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1. The RNAi agent also comprises a 5'-deoxy-5'-C-malonyl.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'- F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-P.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'- F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'- F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-VP. The 5'-VP may be 5'-E-VP, 5'-Z—VP, or combination thereof.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'- F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS2.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'- F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-deoxy-5'-C-malonyl.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'- F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1. The dsRNA agent also comprises a 5'-PS.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'- F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1. The RNAi agent also comprises a 5'-VP. The 5'-VP may be 5'-E-VP, 5'-Z—VP, or combination thereof. In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'- F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1. The RNAi agent also comprises a 5'-PS2.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'- F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1. The RNAi agent also comprises a 5'-deoxy-5'-C-malonyl.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'- F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The RNAi agent also comprises a 5'-P.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'- F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The RNAi agent also comprises a 5'-PS.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'- F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The RNAi agent also comprises a 5'-VP. The 5'-VP may be 5'-E-VP, 5'-Z—VP, or combination thereof.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'- F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The RNAi agent also comprises a 5'-PS 2.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'- F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The RNAi agent also comprises a 5'-deoxy-5'-C-malonyl.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, BF is 2'-OMe or 2'-F, $q^1$ is 9, T1' is 2'-F, $q^2$ is 1, B2' is 2'-OMe or 2'- F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1. The RNAi agent also comprises a 5'-P.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, BF is 2'-OMe or 2'-F, $q^1$ is 9, T1' is 2'-F, $q^2$ is 1, B2' is 2'-OMe or 2'- F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1. The RNAi agent also comprises a 5'-PS.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, BF is 2'-OMe or 2'-F, $q^1$ is 9, T1' is 2'-F, $q^2$ is 1, B2' is 2'-OMe or 2'- F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1. The RNAi agent also comprises a 5'-VP. The 5'-VP may be 5'-E-VP, 5'-Z—VP, or combination thereof.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, BF is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1. The dsRNAi RNA agent also comprises a 5'-PS2.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, BF is 2'-OMe or 2'-F, $q^1$ is 9, T1' is 2'-F, $q^2$ is 1, B2' is 2'-OMe or 2'- F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1. The RNAi agent also comprises a 5'-deoxy-5'-C-malonyl.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'- F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-P.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'- F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'- F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-VP. The 5'-VP may be 5'-E-VP, 5'-Z—VP, or combination thereof.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'- F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS2.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'- F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-deoxy-5'-C-malonyl.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'- F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1. The RNAi agent also comprises a 5'-P.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'- F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1. The RNAi agent also comprises a 5'-PS.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'- F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1. The RNAi agent also comprises a 5'-VP. The 5'-VP may be 5'-E-VP, 5'-Z—VP, or combination thereof.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1. The RNAi agent also comprises a 5'-PS2.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'- F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1. The RNAi agent also comprises a 5'-deoxy-5'-C-malonyl.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'- F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-P.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'- F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'- F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-VP. The 5'-VP may be 5'-E-VP, 5'-Z—VP, or combination thereof.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'- F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS2.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'- F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-deoxy-5'-C-malonyl.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-P and a targeting ligand. In one embodiment, the 5'-P is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS and a targeting ligand. In one embodiment, the 5'-PS is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-VP (e.g., a 5'-E-VP, 5'-Z—VP, or combination thereof), and a targeting ligand.

In one embodiment, the 5'-VP is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS 2 and a targeting ligand. In one embodiment, the 5'-PS 2 is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-deoxy-5'-C-malonyl and a targeting ligand. In one embodiment, the 5'-deoxy-5'-C-malonyl is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The RNAi agent also comprises a 5'-P and a targeting ligand. In one embodiment, the 5'-P is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The RNAi agent also comprises a 5'-PS and a targeting ligand. In one embodiment, the 5'-PS is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two (counting from the 5'-end), and two phosphorothioate internucleotide linkage modifications at positions 1 and 2 and two phosphorothioate internucleotide linkage modifications within positions 18-23 of the antisense strand (counting from the 5'-end). The RNAi agent also comprises a 5'-VP (e.g., a 5'-E-VP, 5'-Z—VP, or combination thereof) and a targeting ligand. In one embodiment, the 5'-VP is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The RNAi agent also comprises a 5'-PS 2 and a targeting ligand. In one embodiment, the 5'-PS 2 is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The RNAi agent also comprises a 5'-deoxy-5'-C-malonyl and a targeting ligand. In one embodiment, the 5'-deoxy-5'-C-malonyl is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-P and a targeting ligand. In one embodiment, the 5'-P is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS and a targeting ligand. In one embodiment, the 5'-PS is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-VP (e.g., a 5'-E-VP, 5'-Z—VP, or combination thereof) and a targeting ligand. In one embodiment, the 5'-VP is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS$_2$ and a targeting ligand. In one embodiment, the 5'-PS 2 is at the 5'-end of the antisense strand, and the targeting ligand is at the 3'-end of the sense strand. In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-deoxy-5'-C-malonyl and a targeting ligand. In one embodiment, the 5'-deoxy-5'-C-malonyl is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-P and a targeting ligand. In one embodiment, the 5'-P is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS and a targeting ligand. In one embodiment, the 5'-PS is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-VP (e.g., a 5'-E-VP, 5'-Z—VP, or combination thereof) and a targeting ligand. In one embodiment, the 5'-VP is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS 2 and a targeting ligand. In one embodiment, the 5'-PS$_2$ is at the 5'-end of the antisense strand, and the targeting ligand is at the 3'-end of the sense strand. In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-deoxy-5'-C-malonyl and a targeting ligand. In one embodiment, the 5'-deoxy-5'-C-malonyl is at the 5'-end of the antisense strand, and the targeting ligand is at the 3'-end of the sense strand.

In a particular embodiment, an RNAi agent of the present invention comprises:

(a) a sense strand having:
  (i) a length of 21 nucleotides;
  (ii) an ASGPR ligand attached to the 3'-end, wherein said ASGPR ligand comprises three GalNAc derivatives attached through a trivalent branched linker; and
  (iii) 2'-F modifications at positions 1, 3, 5, 7, 9 to 11, 13, 17, 19, and 21, and 2'-OMe modifications at positions 2, 4, 6, 8, 12, 14 to 16, 18, and 20 (counting from the 5' end); and (b) an antisense strand having:
  (i) a length of 23 nucleotides;
  (ii) 2'-OMe modifications at positions 1, 3, 5, 9, 11 to 13, 15, 17, 19, 21, and 23, and 2'F modifications at positions 2, 4, 6 to 8, 10, 14, 16, 18, 20, and 22 (counting from the 5' end); and
  (iii) phosphorothioate internucleotide linkages between nucleotide positions 21 and 22, and between nucleotide positions 22 and 23 (counting from the 5' end);

wherein the dsRNA agents have a two nucleotide overhang at the 3'-end of the antisense strand, and a blunt end at the 5'-end of the antisense strand.

In another particular embodiment, an RNAi agent of the present invention comprises:
- (a) a sense strand having:
  - (i) a length of 21 nucleotides;
  - (ii) an ASGPR ligand attached to the 3'-end, wherein said ASGPR ligand comprises three GalNAc derivatives attached through a trivalent branched linker;
  - (iii) 2'-F modifications at positions 1, 3, 5, 7, 9 to 11, 13, 15, 17, 19, and 21, and 2'-OMe modifications at positions 2, 4, 6, 8, 12, 14, 16, 18, and 20 (counting from the 5' end); and
  - (iv) phosphorothioate internucleotide linkages between nucleotide positions 1 and 2, and between nucleotide positions 2 and 3 (counting from the 5' end);

and
- (b) an antisense strand having:
  - (i) a length of 23 nucleotides;
  - (ii) 2'-OMe modifications at positions 1, 3, 5, 7, 9, 11 to 13, 15, 17, 19, and 21 to 23, and 2'F modifications at positions 2, 4, 6, 8, 10, 14, 16, 18, and 20 (counting from the 5' end); and
  - (iii) phosphorothioate internucleotide linkages between nucleotide positions 1 and 2, between nucleotide positions 2 and 3, between nucleotide positions 21 and 22, and between nucleotide positions 22 and 23 (counting from the 5' end);

wherein the RNAi agents have a two nucleotide overhang at the 3'-end of the antisense strand, and a blunt end at the 5'-end of the antisense strand.

In another particular embodiment, a RNAi agent of the present invention comprises:
- (a) a sense strand having:
  - (i) a length of 21 nucleotides;
  - (ii) an ASGPR ligand attached to the 3'-end, wherein said ASGPR ligand comprises three GalNAc derivatives attached through a trivalent branched linker;
  - (iii) 2'-OMe modifications at positions 1 to 6, 8, 10, and 12 to 21, 2'-F modifications at positions 7, and 9, and a deoxy-nucleotide (e.g. dT) at position 11 (counting from the 5' end); and
  - (iv) phosphorothioate internucleotide linkages between nucleotide positions 1 and 2, and between nucleotide positions 2 and 3 (counting from the 5' end);

and
- (b) an antisense strand having:
  - (i) a length of 23 nucleotides;
  - (ii) 2'-OMe modifications at positions 1, 3, 7, 9, 11, 13, 15, 17, and 19 to 23, and 2'-F modifications at positions 2, 4 to 6, 8, 10, 12, 14, 16, and 18 (counting from the 5' end); and
  - (iii) phosphorothioate internucleotide linkages between nucleotide positions 1 and 2, between nucleotide positions 2 and 3, between nucleotide positions 21 and 22, and between nucleotide positions 22 and 23 (counting from the 5' end);

wherein the RNAi agents have a two nucleotide overhang at the 3'-end of the antisense strand, and a blunt end at the 5'-end of the antisense strand.

In another particular embodiment, a RNAi agent of the present invention comprises:
- (a) a sense strand having:
  - (i) a length of 21 nucleotides;
  - (ii) an ASGPR ligand attached to the 3'-end, wherein said ASGPR ligand comprises three GalNAc derivatives attached through a trivalent branched linker;
  - (iii) 2'-OMe modifications at positions 1 to 6, 8, 10, 12, 14, and 16 to 21, and 2'-F modifications at positions 7, 9, 11, 13, and 15; and
  - (iv) phosphorothioate internucleotide linkages between nucleotide positions 1 and 2, and between nucleotide positions 2 and 3 (counting from the 5' end);

and
- (b) an antisense strand having:
  - (i) a length of 23 nucleotides;
  - (ii) 2'-OMe modifications at positions 1, 5, 7, 9, 11, 13, 15, 17, 19, and 21 to 23, and 2'-F modifications at positions 2 to 4, 6, 8, 10, 12, 14, 16, 18, and 20 (counting from the 5' end); and
  - (iii) phosphorothioate internucleotide linkages between nucleotide positions 1 and 2, between nucleotide positions 2 and 3, between nucleotide positions 21 and 22, and between nucleotide positions 22 and 23 (counting from the 5' end);

wherein the RNAi agents have a two nucleotide overhang at the 3'-end of the antisense strand, and a blunt end at the 5'-end of the antisense strand.

In another particular embodiment, a RNAi agent of the present invention comprises:
- (a) a sense strand having:
  - (i) a length of 21 nucleotides;
  - (ii) an ASGPR ligand attached to the 3'-end, wherein said ASGPR ligand comprises three GalNAc derivatives attached through a trivalent branched linker;
  - (iii) 2'-OMe modifications at positions 1 to 9, and 12 to 21, and 2'-F modifications at positions 10, and 11; and
  - (iv) phosphorothioate internucleotide linkages between nucleotide positions 1 and 2, and between nucleotide positions 2 and 3 (counting from the 5' end);

and
- (b) an antisense strand having:
  - (i) a length of 23 nucleotides;
  - (ii) 2'-OMe modifications at positions 1, 3, 5, 7, 9, 11 to 13, 15, 17, 19, and 21 to 23, and 2'-F modifications at positions 2, 4, 6, 8, 10, 14, 16, 18, and 20 (counting from the 5' end); and
  - (iii) phosphorothioate internucleotide linkages between nucleotide positions 1 and 2, between nucleotide positions 2 and 3, between nucleotide positions 21 and 22, and between nucleotide positions 22 and 23 (counting from the 5' end);

wherein the RNAi agents have a two nucleotide overhang at the 3'-end of the antisense strand, and a blunt end at the 5'-end of the antisense strand.

In another particular embodiment, a RNAi agent of the present invention comprises:
- (a) a sense strand having:
  - (i) a length of 21 nucleotides;
  - (ii) an ASGPR ligand attached to the 3'-end, wherein said ASGPR ligand comprises three GalNAc derivatives attached through a trivalent branched linker;
  - (iii) 2'-F modifications at positions 1, 3, 5, 7, 9 to 11, and 13, and 2'-OMe modifications at positions 2, 4, 6, 8, 12, and 14 to 21; and
  - (iv) phosphorothioate internucleotide linkages between nucleotide positions 1 and 2, and between nucleotide positions 2 and 3 (counting from the 5' end);

and
(b) an antisense strand having:
(i) a length of 23 nucleotides;
(ii) 2'-OMe modifications at positions 1, 3, 5 to 7, 9, 11 to 13, 15, 17 to 19, and 21 to 23, and 2'-F modifications at positions 2, 4, 8, 10, 14, 16, and 20 (counting from the 5' end); and
(iii) phosphorothioate internucleotide linkages between nucleotide positions 1 and 2, between nucleotide positions 2 and 3, between nucleotide positions 21 and 22, and between nucleotide positions 22 and 23 (counting from the 5' end);

wherein the RNAi agents have a two nucleotide overhang at the 3'-end of the antisense strand, and a blunt end at the 5'-end of the antisense strand.

In another particular embodiment, a RNAi agent of the present invention comprises:
(a) a sense strand having:
(i) a length of 21 nucleotides;
(ii) an ASGPR ligand attached to the 3'-end, wherein said ASGPR ligand comprises three GalNAc derivatives attached through a trivalent branched linker;
(iii) 2'-OMe modifications at positions 1, 2, 4, 6, 8, 12, 14, 15, 17, and 19 to 21, and 2'-F modifications at positions 3, 5, 7, 9 to 11, 13, 16, and 18; and
(iv) phosphorothioate internucleotide linkages between nucleotide positions 1 and 2, and between nucleotide positions 2 and 3 (counting from the 5' end); and
(b) an antisense strand having:
(i) a length of 25 nucleotides;
(ii) 2'-OMe modifications at positions 1, 4, 6, 7, 9, 11 to 13, 15, 17, and 19 to 23, 2'-F modifications at positions 2, 3, 5, 8, 10, 14, 16, and 18, and deoxy-nucleotides (e.g. dT) at positions 24 and 25 (counting from the 5' end); and
(iii) phosphorothioate internucleotide linkages between nucleotide positions 1 and 2, between nucleotide positions 2 and 3, between nucleotide positions 21 and 22, and between nucleotide positions 22 and 23 (counting from the 5' end);

wherein the RNAi agents have a four nucleotide overhang at the 3'-end of the antisense strand, and a blunt end at the 5'-end of the antisense strand.

In another particular embodiment, a RNAi agent of the present invention comprises:
(a) a sense strand having:
(i) a length of 21 nucleotides;
(ii) an ASGPR ligand attached to the 3'-end, wherein said ASGPR ligand comprises three GalNAc derivatives attached through a trivalent branched linker;
(iii) 2'-OMe modifications at positions 1 to 6, 8, and 12 to 21, and 2'-F modifications at positions 7, and 9 to 11; and
(iv) phosphorothioate internucleotide linkages between nucleotide positions 1 and 2, and between nucleotide positions 2 and 3 (counting from the 5' end); and
(b) an antisense strand having:
(i) a length of 23 nucleotides;
(ii) 2'-OMe modifications at positions 1, 3 to 5, 7, 8, 10 to 13, 15, and 17 to 23, and 2'-F modifications at positions 2, 6, 9, 14, and 16 (counting from the 5' end); and
(iii) phosphorothioate internucleotide linkages between nucleotide positions 1 and 2, between nucleotide positions 2 and 3, between nucleotide positions 21 and 22, and between nucleotide positions 22 and 23 (counting from the 5' end);

wherein the RNAi agents have a two nucleotide overhang at the 3'-end of the antisense strand, and a blunt end at the 5'-end of the antisense strand.

In another particular embodiment, a RNAi agent of the present invention comprises:
(a) a sense strand having:
(i) a length of 21 nucleotides;
(ii) an ASGPR ligand attached to the 3'-end, wherein said ASGPR ligand comprises three GalNAc derivatives attached through a trivalent branched linker;
(iii) 2'-OMe modifications at positions 1 to 6, 8, and 12 to 21, and 2'-F modifications at positions 7, and 9 to 11; and
(iv) phosphorothioate internucleotide linkages between nucleotide positions 1 and 2, and between nucleotide positions 2 and 3 (counting from the 5' end); and
(b) an antisense strand having:
(i) a length of 23 nucleotides;
(ii) 2'-OMe modifications at positions 1, 3 to 5, 7, 10 to 13, 15, and 17 to 23, and 2'-F modifications at positions 2, 6, 8, 9, 14, and 16 (counting from the 5' end); and
(iii) phosphorothioate internucleotide linkages between nucleotide positions 1 and 2, between nucleotide positions 2 and 3, between nucleotide positions 21 and 22, and between nucleotide positions 22 and 23 (counting from the 5' end);

wherein the RNAi agents have a two nucleotide overhang at the 3'-end of the antisense strand, and a blunt end at the 5'-end of the antisense strand.

In another particular embodiment, a RNAi agent of the present invention comprises:
(a) a sense strand having:
(i) a length of 19 nucleotides;
(ii) an ASGPR ligand attached to the 3'-end, wherein said ASGPR ligand comprises three GalNAc derivatives attached through a trivalent branched linker;
(iii) 2'-OMe modifications at positions 1 to 4, 6, and 10 to 19, and 2'-F modifications at positions 5, and 7 to 9; and
(iv) phosphorothioate internucleotide linkages between nucleotide positions 1 and 2, and between nucleotide positions 2 and 3 (counting from the 5' end); and
(b) an antisense strand having:
(i) a length of 21 nucleotides;
(ii) 2'-OMe modifications at positions 1, 3 to 5, 7, 10 to 13, 15, and 17 to 21, and 2'-F modifications at positions 2, 6, 8, 9, 14, and 16 (counting from the 5' end); and
(iii) phosphorothioate internucleotide linkages between nucleotide positions 1 and 2, between nucleotide positions 2 and 3, between nucleotide positions 19 and 20, and between nucleotide positions 20 and 21 (counting from the 5' end);

wherein the RNAi agents have a two nucleotide overhang at the 3'-end of the antisense strand, and a blunt end at the 5'-end of the antisense strand.

In certain embodiments, the iRNA for use in the methods of the invention is an agent selected from agents listed in any one of Tables 2-3. These agents may further comprise a ligand.

III. iRNAs Conjugated to Ligands

Another modification of the RNA of an iRNA of the invention involves chemically linking to the iRNA one or more ligands, moieties or conjugates that enhance the activity, cellular distribution, or cellular uptake of the iRNA e.g., into a cell. Such moieties include but are not limited to lipid moieties such as a cholesterol moiety (Letsinger et al., *Proc. Natl. Acid. Sci. USA*, 1989, 86: 6553-6556). In other embodiments, the ligand is cholic acid (Manoharan et al., *Biorg. Med. Chem. Let.*, 1994, 4:1053-1060), a thioether, e.g., beryl-S-tritylthiol (Manoharan et al., *Ann. N.Y. Acad. Sci.*, 1992, 660:306-309; Manoharan et al., *Biorg. Med. Chem. Let.*, 1993, 3:2765-2770), a thiocholesterol (Oberhauser et al., *Nucl. Acids Res.*, 1992, 20:533-538), an aliphatic chain, e.g., dodecandiol or undecyl residues (Saison-Behmoaras et al., *EMBO J*, 1991, 10:1111-1118; Kabanov et al., *FEBS Lett.*, 1990, 259:327-330; Svinarchuk et al., *Biochimie*, 1993, 75:49-54), a phospholipid, e.g., di-hexadecyl-rac-glycerol or triethyl-ammonium 1,2-di-O-hexadecyl-rac-glycero-3-phosphonate (Manoharan et al., *Tetrahedron Lett.*, 1995, 36:3651-3654; Shea et al., *Nucl. Acids Res.*, 1990, 18:3777-3783), a polyamine or a polyethylene glycol chain (Manoharan et al., *Nucleosides & Nucleotides*, 1995, 14:969-973), or adamantane acetic acid (Manoharan et al., *Tetrahedron Lett.*, 1995, 36:3651-3654), a palmityl moiety (Mishra et al., *Biochim. Biophys. Acta*, 1995, 1264:229-237), or an octadecylamine or hexylamino-carbonyloxycholesterol moiety (Crooke et al., *J. Pharmacol. Exp. Ther.*, 1996, 277:923-937).

In certain embodiments, a ligand alters the distribution, targeting, or lifetime of an iRNA agent into which it is incorporated. In some embodiments a ligand provides an enhanced affinity for a selected target, e.g., molecule, cell or cell type, compartment, e.g., a cellular or organ compartment, tissue, organ or region of the body, as, e.g., compared to a species absent such a ligand. In some embodiments, ligands do not take part in duplex pairing in a duplexed nucleic acid.

Ligands can include a naturally occurring substance, such as a protein (e.g., human serum albumin (HSA), low-density lipoprotein (LDL), or globulin); carbohydrate (e.g., a dextran, pullulan, chitin, chitosan, inulin, cyclodextrin, N-acetylglucosamine, N-acetylgalactosamine, or hyaluronic acid); or a lipid. The ligand can also be a recombinant or synthetic molecule, such as a synthetic polymer, e.g., a synthetic polyamino acid. Examples of polyamino acids include polyamino acid is a polylysine (PLL), poly L-aspartic acid, poly L-glutamic acid, styrene-maleic acid anhydride copolymer, poly(L-lactide-co-glycolied) copolymer, divinyl ether-maleic anhydride copolymer, N-(2-hydroxypropyl)methacrylamide copolymer (HMPA), polyethylene glycol (PEG), polyvinyl alcohol (PVA), polyurethane, poly (2-ethylacryllic acid), N-isopropylacrylamide polymers, or polyphosphazine. Example of polyamines include: polyethylenimine, polylysine (PLL), spermine, spermidine, polyamine, pseudopeptide-polyamine, peptidomimetic polyamine, dendrimer polyamine, arginine, amidine, protamine, cationic lipid, cationic porphyrin, quaternary salt of a polyamine, or an alpha helical peptide.

Ligands can also include targeting groups, e.g., a cell or tissue targeting agent, e.g., a lectin, glycoprotein, lipid or protein, e.g., an antibody, that binds to a specified cell type such as a kidney cell. A targeting group can be a thyrotropin, melanotropin, lectin, glycoprotein, surfactant protein A, Mucin carbohydrate, multivalent lactose, multivalent galactose, N-acetyl-galactosamine, N-acetyl-glucosamine multivalent mannose, multivalent fucose, glycosylated polyaminoacids, multivalent galactose, transferrin, bisphosphonate, polyglutamate, polyaspartate, a lipid, cholesterol, a steroid, bile acid, folate, vitamin B12, vitamin A, biotin, or an RGD peptide or RGD peptide mimetic. In certain embodiments, the ligand is a multivalent galactose, e.g., an N-acetyl-galactosamine.

Other examples of ligands include dyes, intercalating agents (e.g. acridines), cross-linkers (e.g. psoralene, mitomycin C), porphyrins (TPPC4, texaphyrin, Sapphyrin), polycyclic aromatic hydrocarbons (e.g., phenazine, dihydrophenazine), artificial endonucleases (e.g. EDTA), lipophilic molecules, e.g., cholesterol, cholic acid, adamantane acetic acid, 1-pyrene butyric acid, dihydrotestosterone, 1,3-Bis-O (hexadecyl)glycerol, geranyloxyhexyl group, hexadecylglycerol, borneol, menthol, 1,3-propanediol, heptadecyl group, palmitic acid, myristic acid,O3-(oleoyl) lithocholic acid, O3-(oleoyl)cholenic acid, dimethoxytrityl, or phenoxazine) and peptide conjugates (e.g., antennapedia peptide, Tat peptide), alkylating agents, phosphate, amino, mercapto, PEG (e.g., PEG-40K), MPEG, [MPEG]2, polyamino, alkyl, substituted alkyl, radiolabeled markers, enzymes, haptens (e.g. biotin), transport/absorption facilitators (e.g., aspirin, vitamin E, folic acid), synthetic ribonucleases (e.g., imidazole, bisimidazole, histamine, imidazole clusters, acridine-imidazole conjugates, Eu3+ complexes of tetraazamacrocycles), dinitrophenyl, HRP, or AP.

Ligands can be proteins, e.g., glycoproteins, or peptides, e.g., molecules having a specific affinity for a co-ligand, or antibodies e.g., an antibody, that binds to a specified cell type such as a hepatic cell. Ligands can also include hormones and hormone receptors. They can also include non-peptidic species, such as lipids, lectins, carbohydrates, vitamins, cofactors, multivalent lactose, multivalent galactose, N-acetyl-galactosamine, N-acetyl-glucosamine multivalent mannose, or multivalent fucose. The ligand can be, for example, a lipopolysaccharide, an activator of p38 MAP kinase, or an activator of NF-κB.

The ligand can be a substance, e.g., a drug, which can increase the uptake of the iRNA agent into the cell, for example, by disrupting the cell's cytoskeleton, e.g., by disrupting the cell's microtubules, microfilaments, or intermediate filaments. The drug can be, for example, taxol, vincristine, vinblastine, cytochalasin, nocodazole, japlakinolide, latrunculin A, phalloidin, swinholide A, indanocine, or myoservin.

In some embodiments, a ligand attached to an iRNA as described herein acts as a pharmacokinetic modulator (PK modulator). PK modulators include lipophiles, bile acids, steroids, phospholipid analogues, peptides, protein binding agents, PEG, vitamins, etc. Exemplary PK modulators include, but are not limited to, cholesterol, fatty acids, cholic acid, lithocholic acid, dialkylglycerides, diacylglyceride, phospholipids, sphingolipids, naproxen, ibuprofen, vitamin E, biotin. Oligonucleotides that comprise a number of phosphorothioate linkages are also known to bind to serum protein, thus short oligonucleotides, e.g., oligonucleotides of about 5 bases, 10 bases, 15 bases, or 20 bases, comprising multiple of phosphorothioate linkages in the backbone are also amenable to the present invention as ligands (e.g. as PK modulating ligands). In addition, aptamers that bind serum components (e.g. serum proteins) are also suitable for use as PK modulating ligands in the embodiments described herein.

Ligand-conjugated iRNAs of the invention may be synthesized by the use of an oligonucleotide that bears a pendant reactive functionality, such as that derived from the attachment of a linking molecule onto the oligonucleotide (described below). This reactive oligonucleotide may be reacted directly with commercially-available ligands, ligands that are synthesized bearing any of a variety of protecting groups, or ligands that have a linking moiety attached thereto.

The oligonucleotides used in the conjugates of the present invention may be conveniently and routinely made through the well-known technique of solid-phase synthesis. Equipment for such synthesis is sold by several vendors including, for example, Applied Biosystems® (Foster City, Calif.). Any other methods for such synthesis known in the art may additionally or alternatively be employed. It is also known to use similar techniques to prepare other oligonucleotides, such as the phosphorothioates and alkylated derivatives.

In the ligand-conjugated iRNAs and ligand-molecule bearing sequence-specific linked nucleosides of the present invention, the oligonucleotides and oligonucleosides may be assembled on a suitable DNA synthesizer utilizing standard nucleotide or nucleoside precursors, or nucleotide or nucleoside conjugate precursors that already bear the linking moiety, ligand-nucleotide or nucleoside-conjugate precursors that already bear the ligand molecule, or non-nucleoside ligand-bearing building blocks.

When using nucleotide-conjugate precursors that already bear a linking moiety, the synthesis of the sequence-specific linked nucleosides is typically completed, and the ligand molecule is then reacted with the linking moiety to form the ligand-conjugated oligonucleotide. In some embodiments, the oligonucleotides or linked nucleosides of the present invention are synthesized by an automated synthesizer using phosphoramidites derived from ligand-nucleoside conjugates in addition to the standard phosphoramidites and non-standard phosphoramidites that are commercially available and routinely used in oligonucleotide synthesis.

A. Lipid Conjugates

In certain embodiments, the ligand or conjugate is a lipid or lipid-based molecule. In one embodiment, such a lipid or lipid-based molecule binds a serum protein, e.g., human serum albumin (HSA). An HSA binding ligand allows for distribution of the conjugate to a target tissue, e.g., a non-kidney target tissue of the body. For example, the target tissue can be the liver, including parenchymal cells of the liver. Other molecules that can bind HSA can also be used as ligands. For example, naproxen or aspirin can be used. A lipid or lipid-based ligand can (a) increase resistance to degradation of the conjugate, (b) increase targeting or transport into a target cell or cell membrane, or (c) can be used to adjust binding to a serum protein, e.g., HSA.

A lipid based ligand can be used to inhibit, e.g., control the binding of the conjugate to a target tissue. For example, a lipid or lipid-based ligand that binds to HSA more strongly will be less likely to be targeted to the kidney and therefore less likely to be cleared from the body. A lipid or lipid-based ligand that binds to HSA less strongly can be used to target the conjugate to the kidney.

In certain embodiments, the lipid based ligand binds HSA. In one embodiment, it binds HSA with a sufficient affinity such that the conjugate will be distributed to a non-kidney tissue. However, it is preferred that the affinity not be so strong that the HSA-ligand binding cannot be reversed.

In other embodiments, the lipid based ligand binds HSA weakly or not at all. In one embodiment, the conjugate will be distributed to the kidney. Other moieties that target to kidney cells can also be used in place of, or in addition to, the lipid based ligand.

In another aspect, the ligand is a moiety, e.g., a vitamin, which is taken up by a target cell, e.g., a proliferating cell. These are particularly useful for treating disorders characterized by unwanted cell proliferation, e.g., of the malignant or non-malignant type, e.g., cancer cells. Exemplary vitamins include vitamin A, E, and K. Other exemplary vitamins include are B vitamin, e.g., folic acid, B12, riboflavin, biotin, pyridoxal or other vitamins or nutrients taken up by target cells such as liver cells. Also included are HSA and low density lipoprotein (LDL).

B. Cell Permeation Agents

In another aspect, the ligand is a cell-permeation agent, such as, a helical cell-permeation agent. In one embodiment, the agent is amphipathic. An exemplary agent is a peptide such as tat or antennopedia. If the agent is a peptide, it can be modified, including a peptidylmimetic, invertomers, non-peptide or pseudo-peptide linkages, and use of D-amino acids. In one embodiment, the helical agent is an alpha-helical agent, which has a lipophilic and a lipophobic phase.

The ligand can be a peptide or peptidomimetic. A peptidomimetic (also referred to herein as an oligopeptidomimetic) is a molecule capable of folding into a defined three-dimensional structure similar to a natural peptide. The attachment of peptide and peptidomimetics to iRNA agents can affect pharmacokinetic distribution of the iRNA, such as by enhancing cellular recognition and absorption. The peptide or peptidomimetic moiety can be about 5-50 amino acids long, e.g., about 5, 10, 15, 20, 25, 30, 35, 40, 45, or 50 amino acids long.

A peptide or peptidomimetic can be, for example, a cell permeation peptide, cationic peptide, amphipathic peptide, or hydrophobic peptide (e.g., consisting primarily of Tyr, Trp, or Phe). The peptide moiety can be a dendrimer peptide, constrained peptide or crosslinked peptide. In another alternative, the peptide moiety can include a hydrophobic membrane translocation sequence (MTS). An exemplary hydrophobic MTS-containing peptide is RFGF having the amino acid sequence AAVALLPAVLLALLAP (SEQ ID NO: 14). An RFGF analogue (e.g., amino acid sequence AALLPVL-LAAP (SEQ ID NO:15) containing a hydrophobic MTS can also be a targeting moiety. The peptide moiety can be a "delivery" peptide, which can carry large polar molecules including peptides, oligonucleotides, and protein across cell membranes. For example, sequences from the HIV Tat protein (GRKKRRQRRRPPQ (SEQ ID NO:16) and the *Drosophila* Antennapedia protein (RQIKIWFQNRRMKWKK (SEQ ID NO:17) have been found to be capable of functioning as delivery peptides. A peptide or peptidomimetic can be encoded by a random sequence of DNA, such as a peptide identified from a phage-display library, or one-bead-one-compound (OB OC) combinatorial library (Lam et al., Nature, 354:82-84, 1991). Examples of a peptide or peptidomimetic tethered to a dsRNA agent via an incorporated monomer unit for cell targeting purposes is an arginine-glycine-aspartic acid (RGD)-peptide, or RGD mimic. A peptide moiety can range in length from about 5 amino acids to about 40 amino acids. The peptide moieties can have a structural modification, such as to increase stability or direct conformational properties. Any of the structural modifications described below can be utilized.

An RGD peptide for use in the compositions and methods of the invention may be linear or cyclic, and may be modified, e.g., glycosylated or methylated, to facilitate targeting to a specific tissue(s). RGD-containing peptides and peptidiomimemtics may include D-amino acids, as well as synthetic RGD mimics. In addition to RGD, one can use other moieties that target the integrin ligand, e.g., PECAM-1 or VEGF.

A "cell permeation peptide" is capable of permeating a cell, e.g., a microbial cell, such as a bacterial or fungal cell, or a mammalian cell, such as a human cell. A microbial cell-permeating peptide can be, for example, an α-helical linear peptide (e.g., LL-37 or Ceropin P1), a disulfide bond-containing peptide (e.g., α-defensin, β-defensin or bactenecin), or a peptide containing only one or two dominating amino acids (e.g., PR-39 or indolicidin). A cell permeation peptide can also include a nuclear localization signal (NLS). For example, a cell permeation peptide can be a bipartite amphipathic peptide, such as MPG, which is derived from the fusion peptide domain of HIV-1 gp41 and the NLS of SV40 large T antigen (Simeoni et al., Nucl. Acids Res. 31:2717-2724, 2003).

C. Carbohydrate Conjugates

In some embodiments of the compositions and methods of the invention, an iRNA further comprises a carbohydrate. The carbohydrate conjugated iRNA is advantageous for the in vivo delivery of nucleic acids, as well as compositions suitable for in vivo therapeutic use, as described herein. As used herein, "carbohydrate" refers to a compound which is either a carbohydrate per se made up of one or more monosaccharide units having at least 6 carbon atoms (which can be linear, branched or cyclic) with an oxygen, nitrogen or sulfur atom bonded to each carbon atom; or a compound having as a part thereof a carbohydrate moiety made up of one or more monosaccharide units each having at least six carbon atoms (which can be linear, branched or cyclic), with an oxygen, nitrogen or sulfur atom bonded to each carbon atom. Representative carbohydrates include the sugars (mono-, di-, tri-, and oligosaccharides containing from about 4, 5, 6, 7, 8, or 9 monosaccharide units), and polysaccharides such as starches, glycogen, cellulose and polysaccharide gums Specific monosaccharides include C5 and above (e.g., C5, C6, C7, or C8) sugars; di- and trisaccharides include sugars having two or three monosaccharide units (e.g., C5, C6, C7, or C8).

In certain embodiments, a carbohydrate conjugate for use in the compositions and methods of the invention is a monosaccharide.

In certain embodiments, the monosaccharide is an N-acetylgalactosamine (GalNAc). GalNAc conjugates, which comprise one or more N-acetylgalactosamine (GalNAc) derivatives, are described, for example, in U.S. Pat. No. 8,106,022, the entire content of which is hereby incorporated herein by reference. In some embodiments, the GalNAc conjugate serves as a ligand that targets the iRNA to particular cells. In some embodiments, the GalNAc conjugate targets the iRNA to liver cells, e.g., by serving as a ligand for the asialoglycoprotein receptor of liver cells (e.g., hepatocytes).

In some embodiments, the carbohydrate conjugate comprises one or more GalNAc derivatives. The GalNAc derivatives may be attached via a linker, e.g., a bivalent or trivalent branched linker. In some embodiments the GalNAc conjugate is conjugated to the 3' end of the sense strand. In some embodiments, the GalNAc conjugate is conjugated to the iRNA agent (e.g., to the 3' end of the sense strand) via a linker, e.g., a linker as described herein. In some embodiments the GalNAc conjugate is conjugated to the 5' end of the sense strand. In some embodiments, the GalNAc conjugate is conjugated to the iRNA agent (e.g., to the 5' end of the sense strand) via a linker, e.g., a linker as described herein.

In certain embodiments of the invention, the GalNAc or GalNAc derivative is attached to an iRNA agent of the invention via a monovalent linker. In some embodiments, the GalNAc or GalNAc derivative is attached to an iRNA agent of the invention via a bivalent linker. In yet other embodiments of the invention, the GalNAc or GalNAc derivative is attached to an iRNA agent of the invention via a trivalent linker. In other embodiments of the invention, the GalNAc or GalNAc derivative is attached to an iRNA agent of the invention via a tetravalent linker.

In certain embodiments, the double stranded RNAi agents of the invention comprise one GalNAc or GalNAc derivative attached to the iRNA agent. In certain embodiments, the double stranded RNAi agents of the invention comprise a plurality (e.g., 2, 3, 4, 5, or 6) GalNAc or GalNAc derivatives, each independently attached to a plurality of nucleotides of the double stranded RNAi agent through a plurality of monovalent linkers.

In some embodiments, for example, when the two strands of an iRNA agent of the invention are part of one larger molecule connected by an uninterrupted chain of nucleotides between the 3'-end of one strand and the 5'-end of the respective other strand forming a hairpin loop comprising, a plurality of unpaired nucleotides, each unpaired nucleotide within the hairpin loop may independently comprise a GalNAc or GalNAc derivative attached via a monovalent linker. The hairpin loop may also be formed by an extended overhang in one strand of the duplex.

In some embodiments, for example, when the two strands of an iRNA agent of the invention are part of one larger molecule connected by an uninterrupted chain of nucleotides between the 3'-end of one strand and the 5'-end of the respective other strand forming a hairpin loop comprising, a plurality of unpaired nucleotides, each unpaired nucleotide within the hairpin loop may independently comprise a GalNAc or GalNAc derivative attached via a monovalent linker. The hairpin loop may also be formed by an extended overhang in one strand of the duplex.

In one embodiment, a carbohydrate conjugate for use in the compositions and methods of the invention is selected from the group consisting of:

Formula II
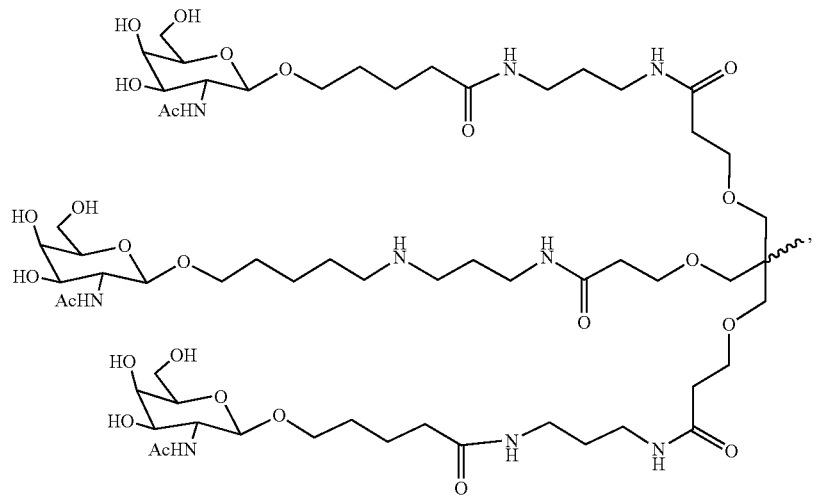
Formula III
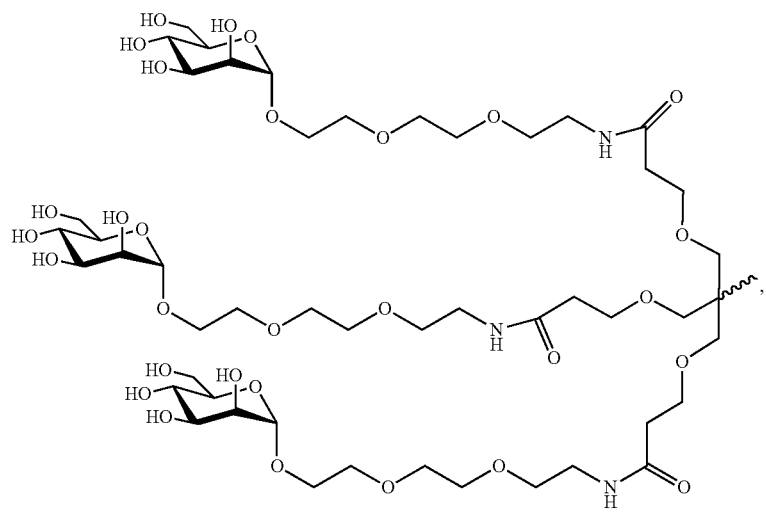
Formula IV
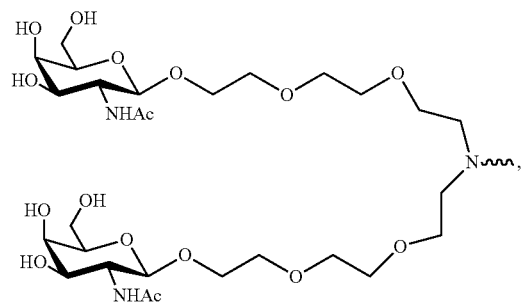
Formula V
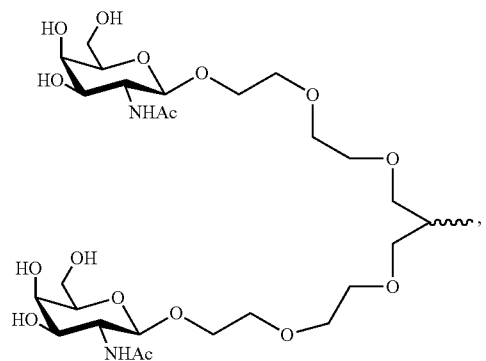

Formula VI
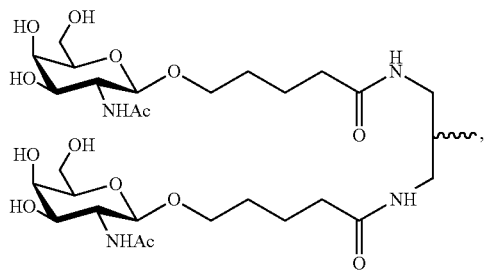
Formula VII
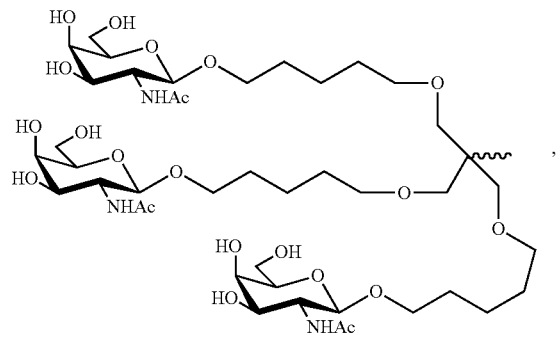
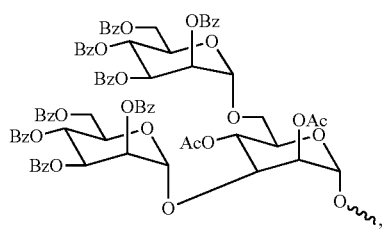
Formula VIII
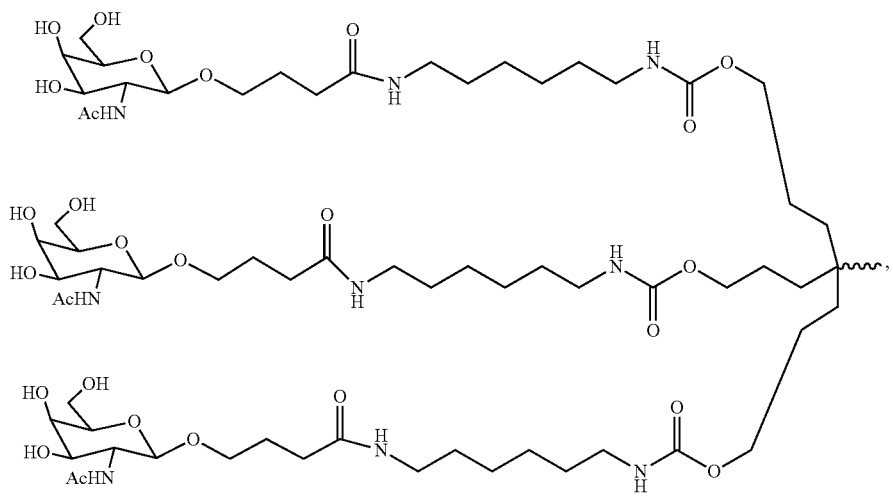
Formula IX
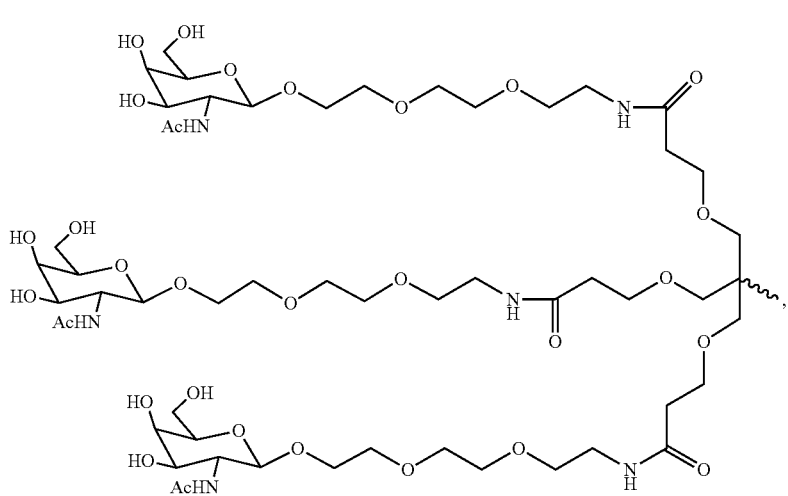
Formula X Formula XI
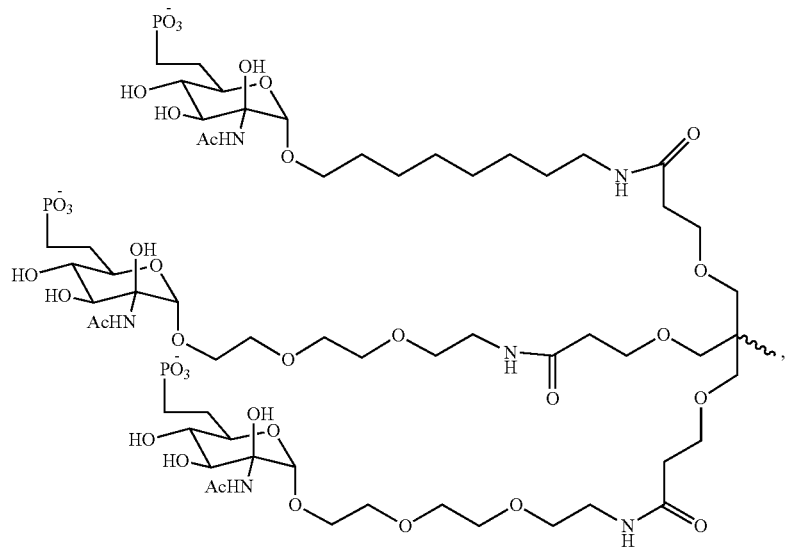
Formula XII
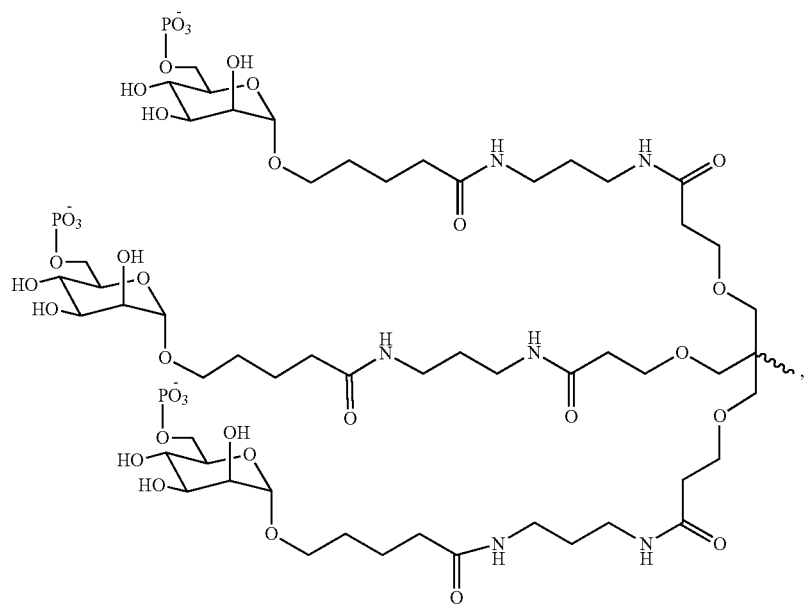
Formula XIII
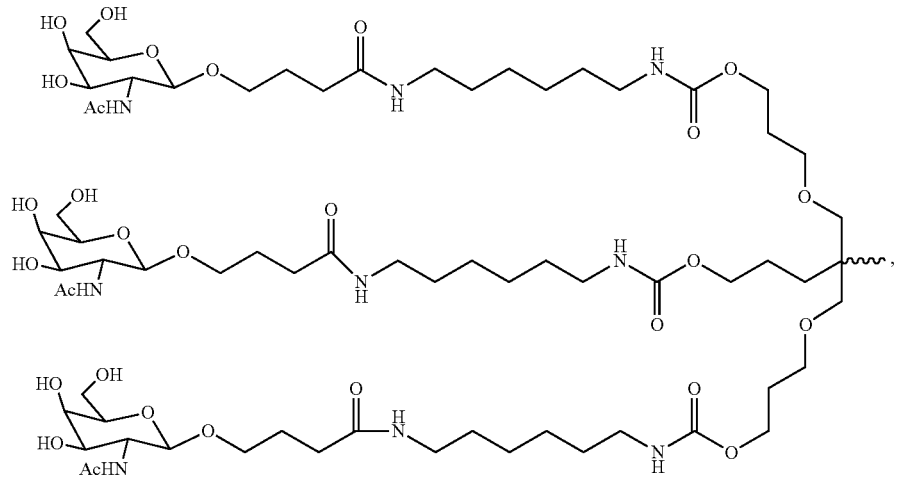

Formula XIV
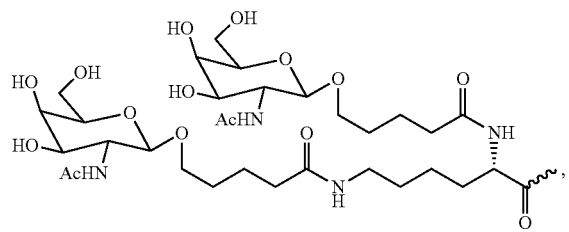
Formula XV
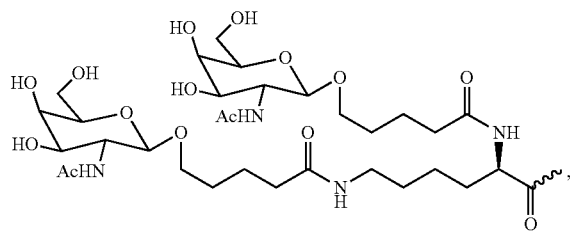
Formula XVI
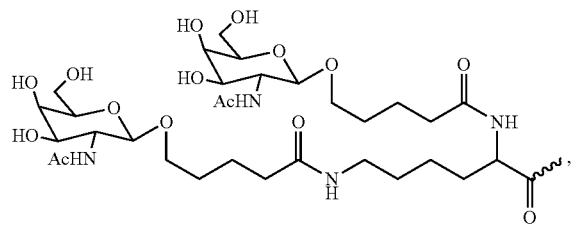
Formula XVII
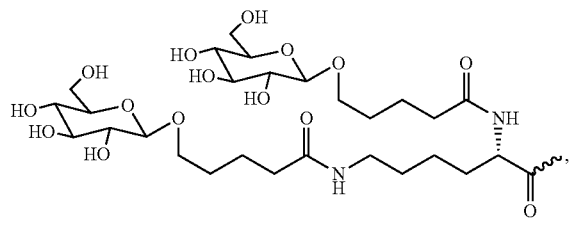
Formula XVIII
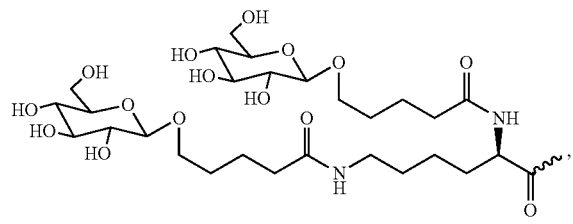
Formula XIX
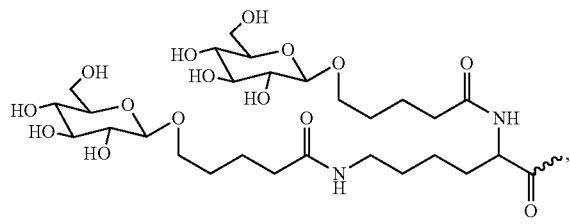
Formula XX
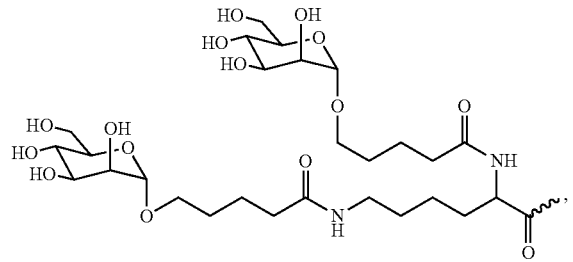
Formula XXI
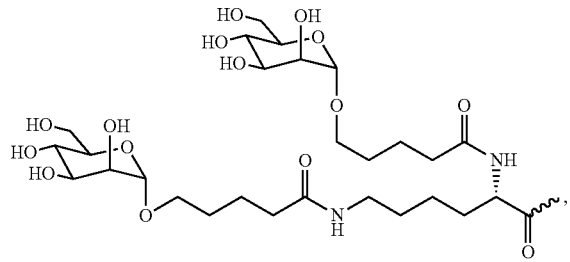
Formula XXII
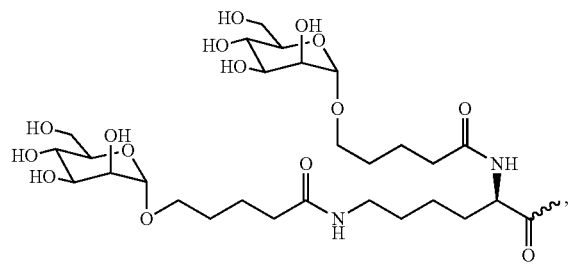
Formula XXIII
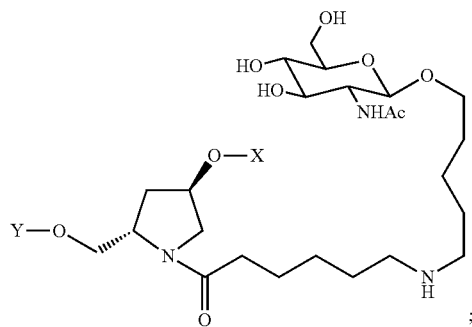

(Formula XXIV)
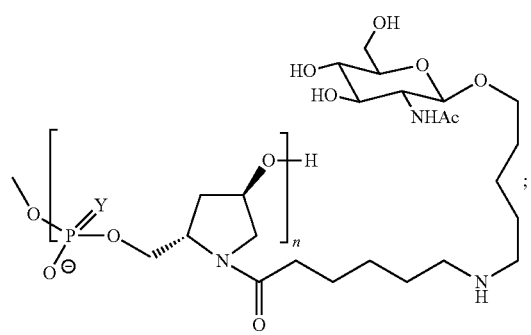
wherein Y is O or S and n is 3-6;
(Formula XXV)
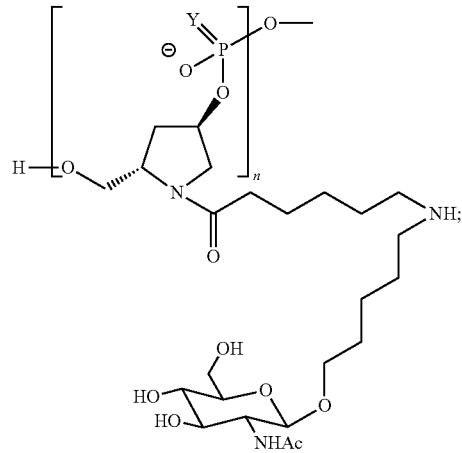
wherein Y is O or S and n is 3-6
Formula XXVI
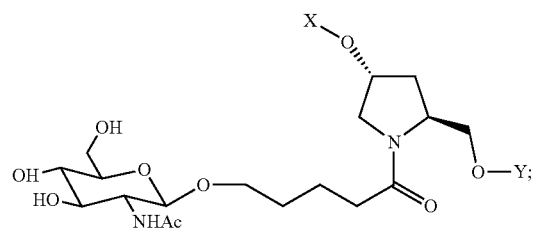
(Formula XXVII)
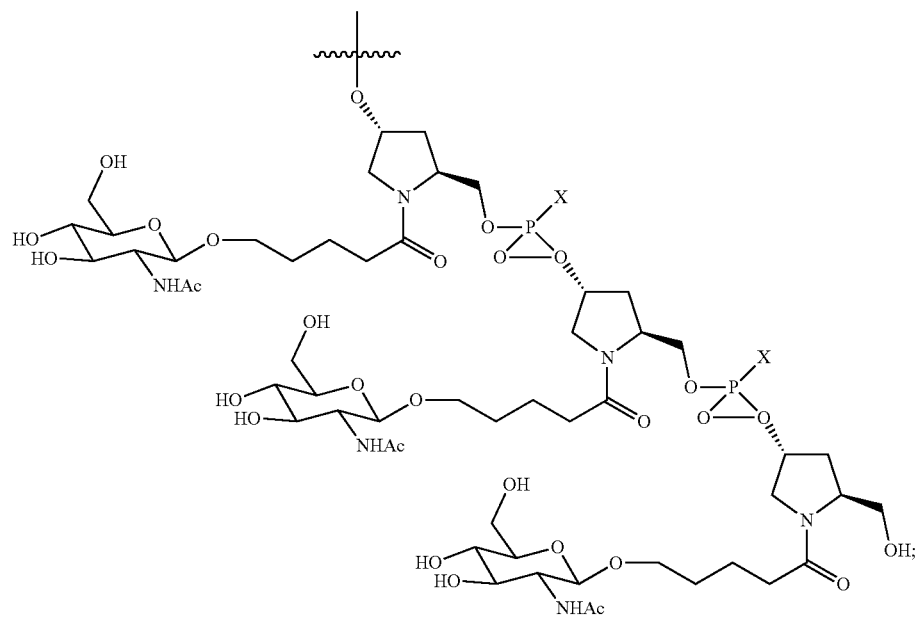
wherein X is O or S

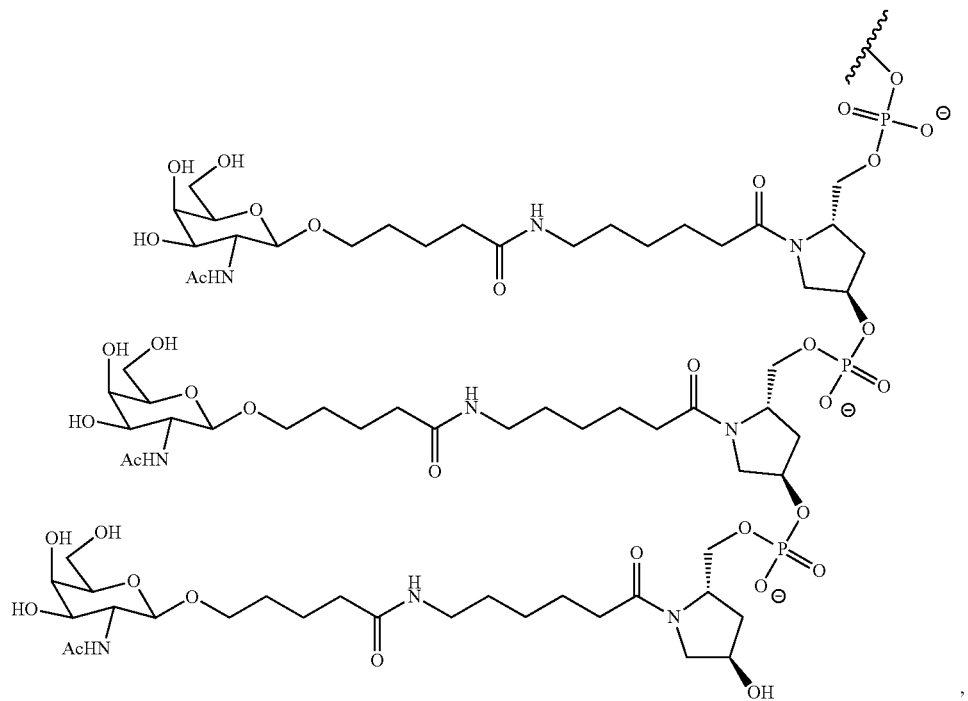
Formula XXVII
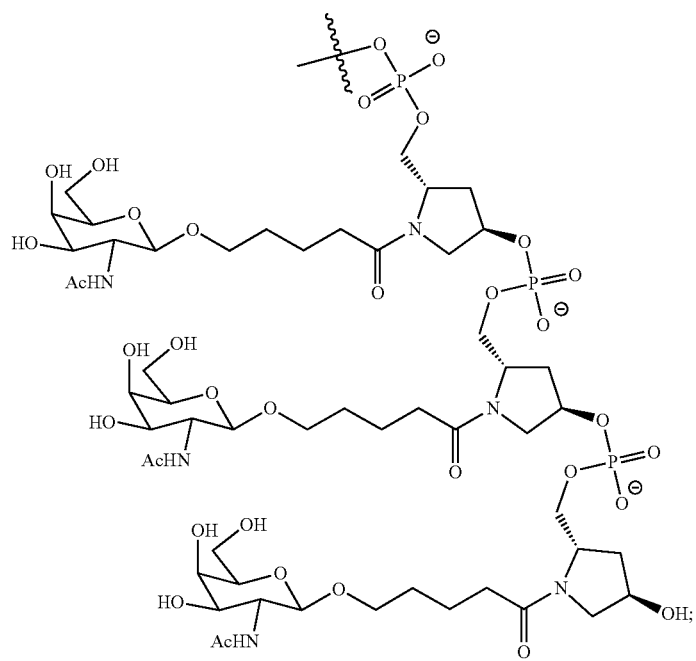
Formula XXIX

Formula XXX
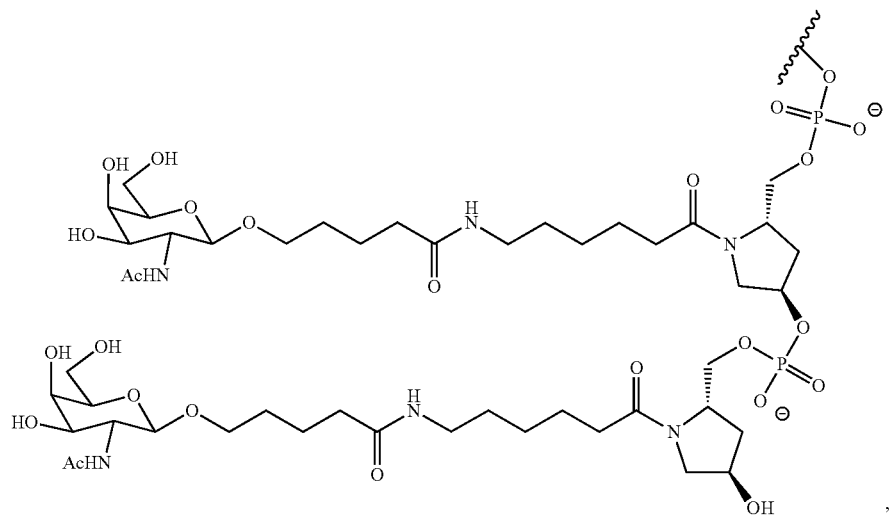
Formula XXXI
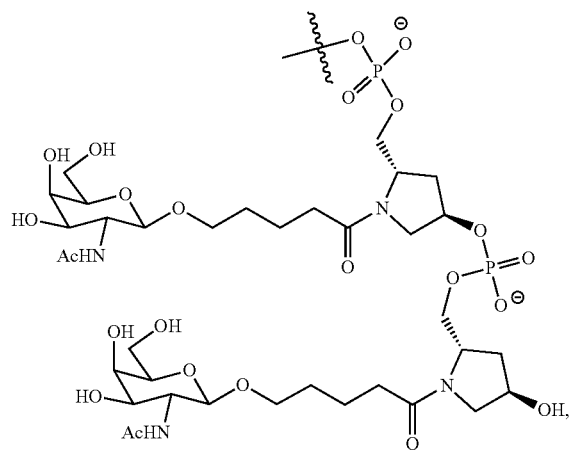
Formula XXXII
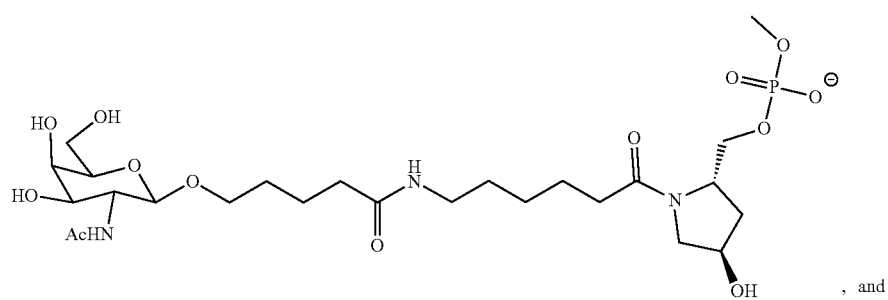
, and

Formula XXXIII
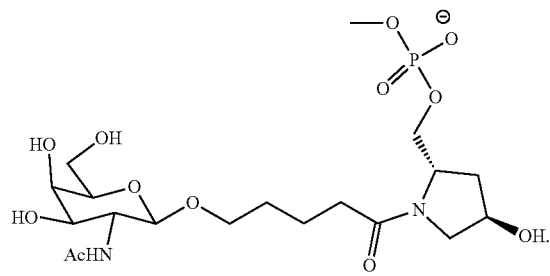
Formula XXXIV
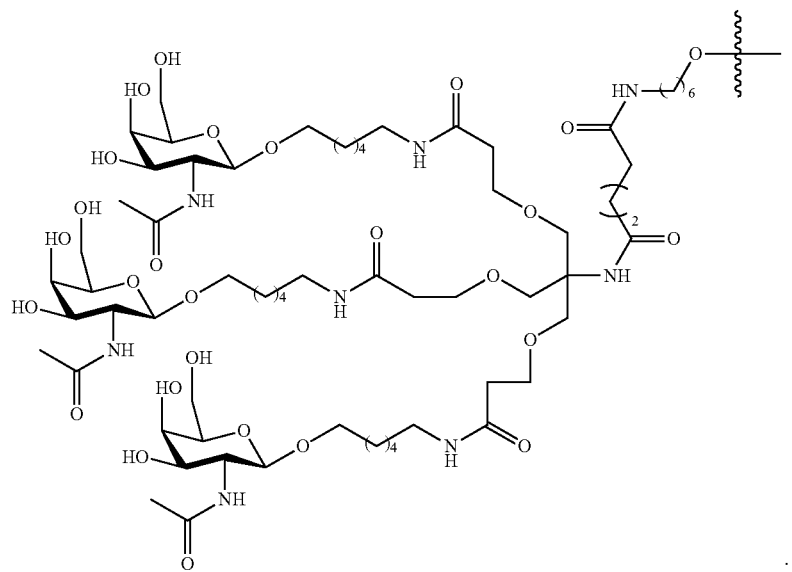
In another embodiment, a carbohydrate conjugate for use in the compositions and methods of the invention is a monosaccharide. In one embodiment, the monosaccharide is an N-acetylgalactosamine, such as
Formula II
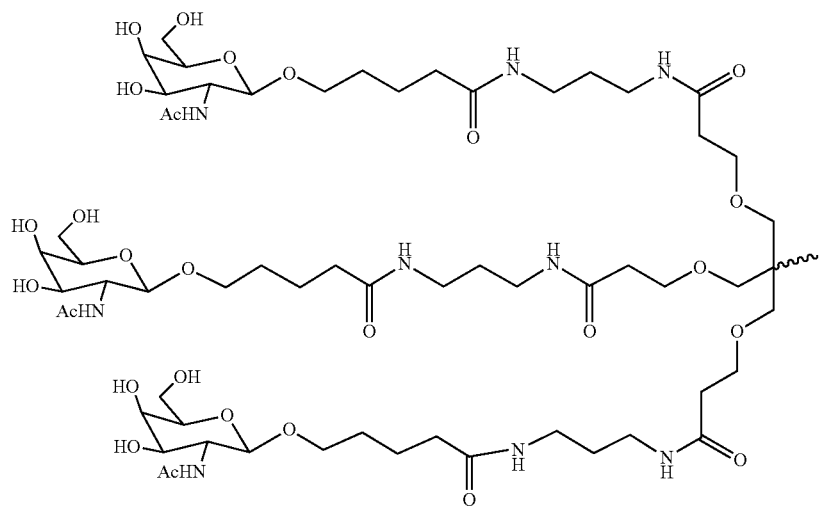

In some embodiments, the RNAi agent is attached to the carbohydrate conjugate via a linker as shown in the following schematic, wherein X is O or S.
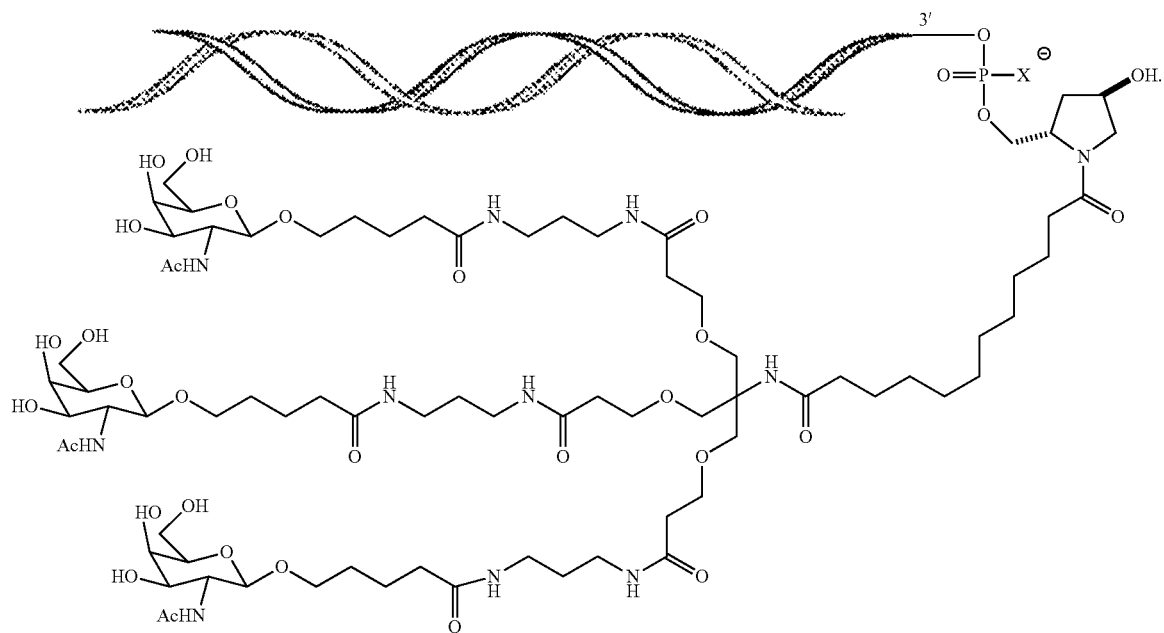
In some embodiments, the RNAi agent is conjugated to L96 as defined in Table 1 and shown below:
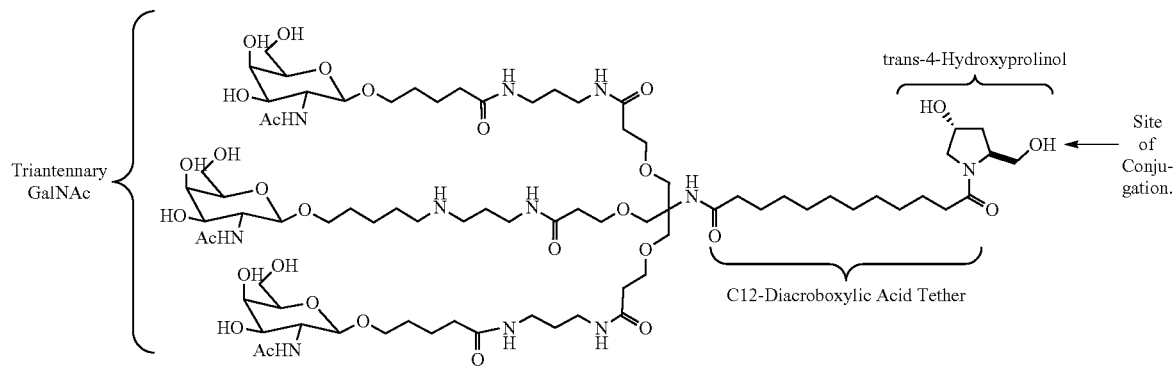

Another representative carbohydrate conjugate for use in the embodiments described herein includes, but is not limited to,

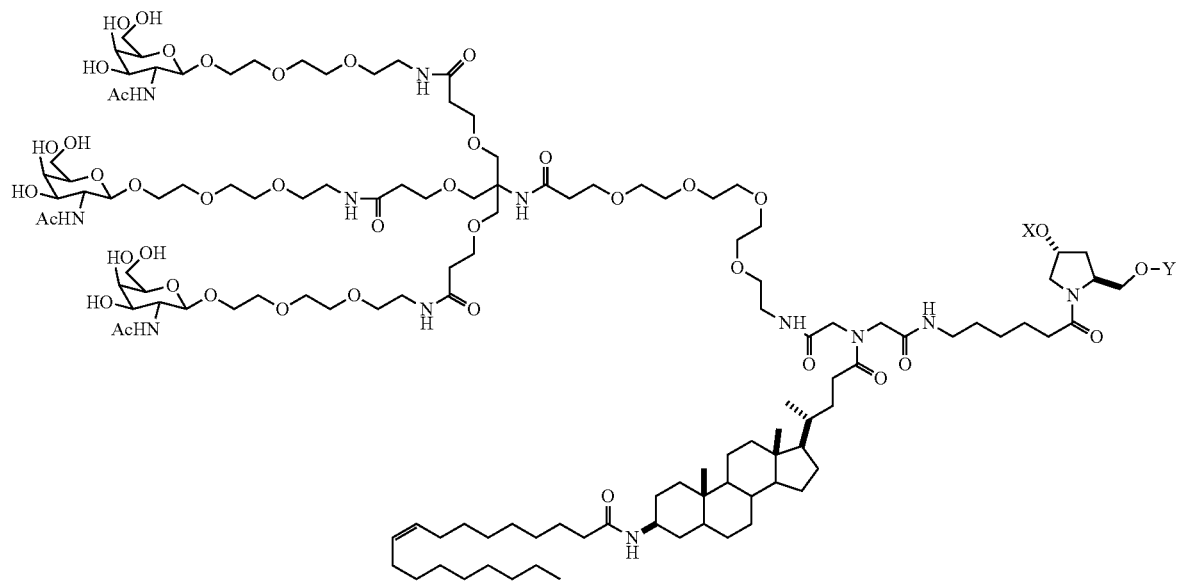

(Formula XXXVI), when one of X or Y is an oligonucleotide, the other is a hydrogen.

In some embodiments, a suitable ligand is a ligand disclosed in WO 2019/055633, the entire contents of which are incorporated herein by reference. In one embodiment the ligand comprises the structure below:

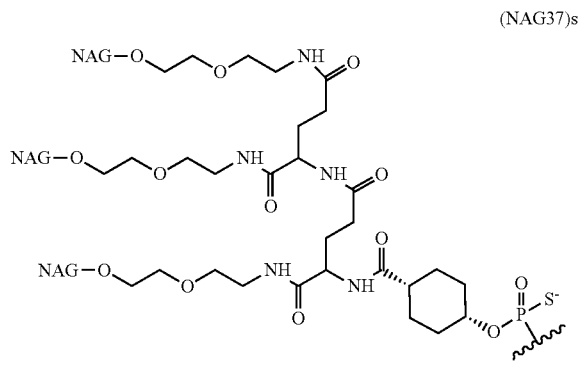

(NAG37)s

In certain embodiments of the invention, the GalNAc or GalNAc derivative is attached to an iRNA agent of the invention via a monovalent linker. In some embodiments, the GalNAc or GalNAc derivative is attached to an iRNA agent of the invention via a bivalent linker. In yet other embodiments of the invention, the GalNAc or GalNAc derivative is attached to an iRNA agent of the invention via a trivalent linker.

In one embodiment, the double stranded RNAi agents of the invention comprise one or more GalNAc or GalNAc derivative attached to the iRNA agent. The GalNAc may be attached to any nucleotide via a linker on the sense strand or antsisense strand. The GalNac may be attached to the 5'-end of the sense strand, the 3' end of the sense strand, the 5'-end of the antisense strand, or the 3'-end of the antisense strand.

In one embodiment, the GalNAc is attached to the 3' end of the sense strand, e.g., via a trivalent linker.

In other embodiments, the double stranded RNAi agents of the invention comprise a plurality (e.g., 2, 3, 4, 5, or 6) GalNAc or GalNAc derivatives, each independently attached to a plurality of nucleotides of the double stranded RNAi agent through a plurality of linkers, e.g., monovalent linkers.

In some embodiments, for example, when the two strands of an iRNA agent of the invention is part of one larger molecule connected by an uninterrupted chain of nucleotides between the 3'-end of one strand and the 5'-end of the respective other strand forming a hairpin loop comprising, a plurality of unpaired nucleotides, each unpaired nucleotide within the hairpin loop may independently comprise a GalNAc or GalNAc derivative attached via a monovalent linker.

In some embodiments, the carbohydrate conjugate further comprises one or more additional ligands as described above, such as, but not limited to, a PK modulator or a cell permeation peptide.

Additional carbohydrate conjugates and linkers suitable for use in the present invention include those described in PCT Publication Nos. WO 2014/179620 and WO 2014/179627, the entire contents of each of which are incorporated herein by reference.

D. Linkers

In some embodiments, the conjugate or ligand described herein can be attached to an iRNA oligonucleotide with various linkers that can be cleavable or non-cleavable.

The term "linker" or "linking group" means an organic moiety that connects two parts of a compound, e.g., covalently attaches two parts of a compound. Linkers typically comprise a direct bond or an atom such as oxygen or sulfur, a unit such as NR8, C(O), C(O)NH, SO, $SO_2$, $SO_2NH$ or a chain of atoms, such as, but not limited to, substituted or unsubstituted alkyl, substituted or unsubstituted alkenyl, substituted or unsubstituted alkynyl, arylalkyl, arylalkenyl, arylalkynyl, heteroarylalkyl, heteroarylalkenyl, heteroarylalkynyl, heterocyclylalkyl, heterocyclylalkenyl, heterocyclylalkynyl, aryl, heteroaryl, heterocyclyl, cycloalkyl, cycloalkenyl, alkylarylalkyl, alkylarylalkenyl, alkylarylalkynyl, alkenylarylalkyl, alkenylarylalkenyl, alkenylarylalkynyl, alkynylarylalkyl, alkynylarylalkenyl, alkynylarylalkynyl, alkylheteroarylalkyl, alkylheteroarylalkenyl, alkylheteroarylalkynyl, alkenylheteroarylalkyl, alkenylheteroarylalkenyl, alkenylheteroarylalkynyl, alkynylheteroarylalkyl, alkynylheteroarylalkenyl, alkynylheteroarylalkynyl, alkylheterocyclylalkyl, alkylheterocyclylalkenyl, alkylhererocyclylalkynyl, alkenylheterocyclylalkyl, alkenylheterocyclylalkenyl, alkenylheterocyclylalkynyl, alkynylheterocyclylalkyl, alkynylheterocyclylalkenyl, alkynylheterocyclylalkynyl, alkylaryl, alkenylaryl, alkynylaryl, alkylheteroaryl, alkenylheteroaryl, alkynylhereroaryl, which one or more methylenes can be interrupted or terminated by O, S, S(O), $SO_2$, $N(R_8)$, C(O), substituted or unsubstituted aryl, substituted or unsubstituted heteroaryl, or substituted or unsubstituted heterocyclic; where R8 is hydrogen, acyl, aliphatic, or substituted aliphatic. In one embodiment, the linker is about 1-24 atoms, 2-24, 3-24, 4-24, 5-24, 6-24, 6-18, 7-18, 8-18, 7-17, 8-17, 6-16, 7-17, or 8-16 atoms.

A cleavable linking group is one which is sufficiently stable outside the cell, but which upon entry into a target cell is cleaved to release the two parts the linker is holding together. In an exemplary embodiment, the cleavable linking group is cleaved at least about 10 times, 20, times, 30 times, 40 times, 50 times, 60 times, 70 times, 80 times, 90 times, or more, or at least 100 times faster in a target cell or under a first reference condition (which can, e.g., be selected to mimic or represent intracellular conditions) than in the blood of a subject, or under a second reference condition (which can, e.g., be selected to mimic or represent conditions found in the blood or serum).

Cleavable linking groups are susceptible to cleavage agents, e.g., pH, redox potential, or the presence of degradative molecules. Generally, cleavage agents are more prevalent or found at higher levels or activities inside cells than in serum or blood. Examples of such degradative agents include: redox agents which are selected for particular substrates or which have no substrate specificity, including, e.g., oxidative or reductive enzymes or reductive agents such as mercaptans, present in cells, that can degrade a redox cleavable linking group by reduction; esterases; endosomes or agents that can create an acidic environment, e.g., those that result in a pH of five or lower; enzymes that can hydrolyze or degrade an acid cleavable linking group by acting as a general acid, peptidases (which can be substrate specific), and phosphatases.

A cleavable linkage group, such as a disulfide bond can be susceptible to pH. The pH of human serum is 7.4, while the average intracellular pH is slightly lower, ranging from about 7.1-7.3. Endosomes have a more acidic pH, in the range of 5.5-6.0, and lysosomes have an even more acidic pH at around 5.0. Some linkers will have a cleavable linking group that is cleaved at a selected pH, thereby releasing a cationic lipid from the ligand inside the cell, or into the desired compartment of the cell.

A linker can include a cleavable linking group that is cleavable by a particular enzyme. The type of cleavable linking group incorporated into a linker can depend on the cell to be targeted. For example, a liver-targeting ligand can be linked to a cationic lipid through a linker that includes an ester group. Liver cells are rich in esterases, and therefore the linker will be cleaved more efficiently in liver cells than in cell types that are not esterase-rich. Other cell-types rich in esterases include cells of the lung, renal cortex, and testis.

Linkers that contain peptide bonds can be used when targeting cell types rich in peptidases, such as liver cells and synoviocytes.

In general, the suitability of a candidate cleavable linking group can be evaluated by testing the ability of a degradative agent (or condition) to cleave the candidate linking group. It will also be desirable to also test the candidate cleavable linking group for the ability to resist cleavage in the blood or when in contact with other non-target tissue. Thus, one can determine the relative susceptibility to cleavage between a first and a second condition, where the first is selected to be indicative of cleavage in a target cell and the second is selected to be indicative of cleavage in other tissues or biological fluids, e.g., blood or serum. The evaluations can be carried out in cell free systems, in cells, in cell culture, in organ or tissue culture, or in whole animals. It can be useful to make initial evaluations in cell-free or culture conditions and to confirm by further evaluations in whole animals. In certain embodiments, useful candidate compounds are cleaved at least about 2, 4, 10, 20, 30, 40, 50, 60, 70, 80, 90, or 100 times faster in the cell (or under in vitro conditions selected to mimic intracellular conditions) as compared to blood or serum (or under in vitro conditions selected to mimic extracellular conditions).

i. Redox Cleavable Linking Groups

In certain embodiments, a cleavable linking group is a redox cleavable linking group that is cleaved upon reduction or oxidation. An example of reductively cleavable linking group is a disulphide linking group (—S—S—). To determine if a candidate cleavable linking group is a suitable "reductively cleavable linking group," or for example is suitable for use with a particular iRNA moiety and particular targeting agent one can look to methods described herein. For example, a candidate can be evaluated by incubation with dithiothreitol (DTT), or other reducing agent using reagents know in the art, which mimic the rate of cleavage which would be observed in a cell, e.g., a target cell. The candidates can also be evaluated under conditions which are selected to mimic blood or serum conditions. In one, candidate compounds are cleaved by at most about 10% in the blood. In other embodiments, useful candidate compounds are degraded at least about 2, 4, 10, 20, 30, 40, 50, 60, 70, 80, 90, or about 100 times faster in the cell (or under in vitro conditions selected to mimic intracellular conditions) as compared to blood (or under in vitro conditions selected to mimic extracellular conditions). The rate of cleavage of candidate compounds can be determined using standard enzyme kinetics assays under conditions chosen to mimic intracellular media and compared to conditions chosen to mimic extracellular media.

ii. Phosphate-Based Cleavable Linking Groups

In other embodiments, a cleavable linker comprises a phosphate-based cleavable linking group. A phosphate-based cleavable linking group is cleaved by agents that degrade or hydrolyze the phosphate group. An example of an agent that cleaves phosphate groups in cells are enzymes such as phosphatases in cells. Examples of phosphate-based linking groups are —O—P(O)(ORk)-O—, —O—P(S)(ORk)-O—, —O—P(S)(SRk)-O—, —S—P(O)(ORk)-O—, —O—P(O)(ORk)-S—, —S—P(O)(ORk)-S—, —O—P(S)(ORk)-S—, —S—P(S)(ORk)-O—, —O—P(O)(Rk)-O—, —O—P(S)(Rk)-O—, —S—P(O)(Rk)-O—, —S—P(S)(Rk)-O—, —S—P(O)(Rk)-S—, —O—P(S)(Rk)-S—, wherein Rk at each occurrence can be, independently, C1-C20 alkyl, C1-C20 haloalkyl, C6-C10 aryl, or C7-C12 aralkyl. Exemplary embodiments include —O—P(O)(OH)—O—, —O—P(S)(OH)—O—, —O—P(S)(SH)—O—, —S—P(O)(OH)—O—, —O—P(O)(OH)—S—, —S—P(O)(OH)—S—, —O—P(S)(OH)—S—, —S—P(S)(OH)—O—, —O—P(O)(H)—O—, —O—P(S)(H)—O—, —S—P(O)(H)—O, —S—P(S)(H)—O—, —S—P(O)(H)—S—, and —O—P(S)(H)—S—. In certain embodiments a phosphate-based linking group is —O—P(O)(OH)—O—. These candidates can be evaluated using methods analogous to those described above.\ iii. Acid Cleavable Linking Groups

In other embodiments, a cleavable linker comprises an acid cleavable linking group. An acid cleavable linking group is a linking group that is cleaved under acidic conditions. In certain embodiments acid cleavable linking groups are cleaved in an acidic environment with a pH of about 6.5 or lower (e.g., about 6.0, 5.5, 5.0, or lower), or by agents such as enzymes that can act as a general acid. In a cell, specific low pH organelles, such as endosomes and lysosomes can provide a cleaving environment for acid cleavable linking groups. Examples of acid cleavable linking groups include but are not limited to hydrazones, esters, and esters of amino acids. Acid cleavable groups can have the general formula —C=NN—, C(O)O, or —OC(O). An exemplary embodiment is when the carbon attached to the oxygen of the ester (the alkoxy group) is an aryl group, substituted alkyl group, or tertiary alkyl group such as dimethyl pentyl or t-butyl. These candidates can be evaluated using methods analogous to those described above.

iv. Ester-Based Linking Groups

In other embodiments, a cleavable linker comprises an ester-based cleavable linking group. An ester-based cleavable linking group is cleaved by enzymes such as esterases and amidases in cells. Examples of ester-based cleavable linking groups include, but are not limited to, esters of alkylene, alkenylene and alkynylene groups. Ester cleavable linking groups have the general formula —C(O)O—, or —OC(O)—. These candidates can be evaluated using methods analogous to those described above.

v. Peptide-Based Cleaving Groups

In yet other embodiments, a cleavable linker comprises a peptide-based cleavable linking group. A peptide-based cleavable linking group is cleaved by enzymes such as peptidases and proteases in cells. Peptide-based cleavable linking groups are peptide bonds formed between amino acids to yield oligopeptides (e.g., dipeptides, tripeptides etc.) and polypeptides. Peptide-based cleavable groups do not include the amide group (—C(O)NH—). The amide group can be formed between any alkylene, alkenylene or alkynelene. A peptide bond is a special type of amide bond formed between amino acids to yield peptides and proteins. The peptide based cleavage group is generally limited to the peptide bond (i.e., the amide bond) formed between amino acids yielding peptides and proteins and does not include the entire amide functional group. Peptide-based cleavable linking groups have the general formula —NHCHRAC(O)NHCHRBC(O)—, where RA and RB are the R groups of the two adjacent amino acids. These candidates can be evaluated using methods analogous to those described above.

In some embodiments, an iRNA of the invention is conjugated to a carbohydrate through a linker. Non-limiting examples of iRNA carbohydrate conjugates with linkers of the compositions and methods of the invention include, but are not limited to, (Formula XXXVII)

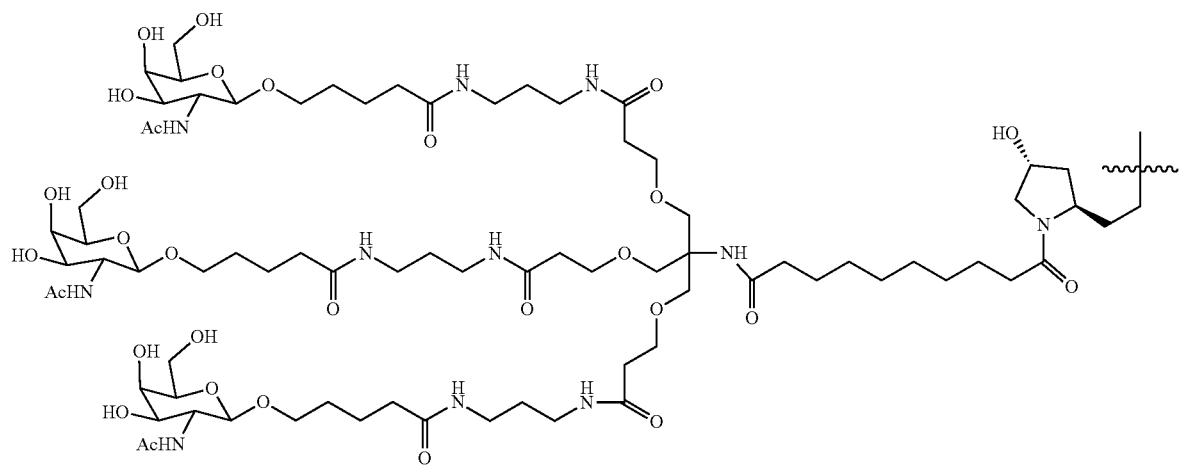

(Formula XXXVIII)
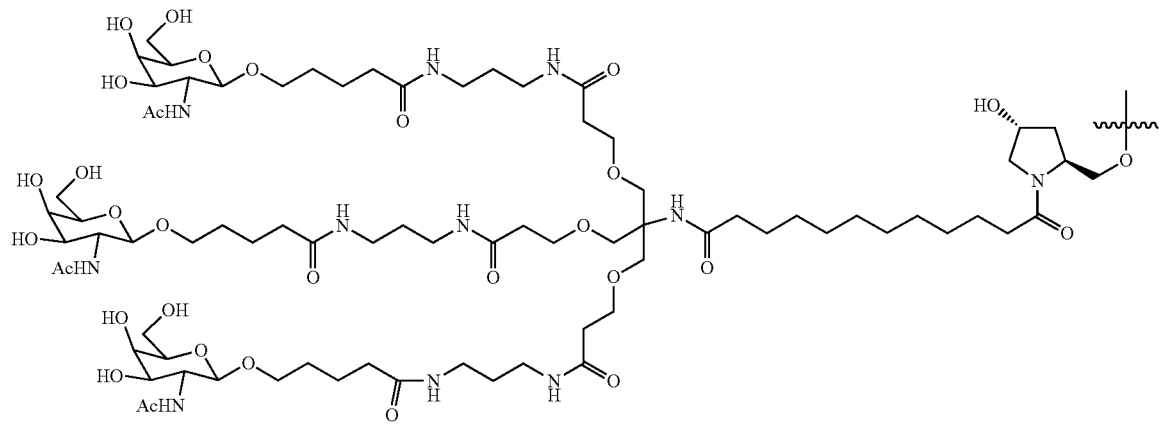
(Formula XXXIX)
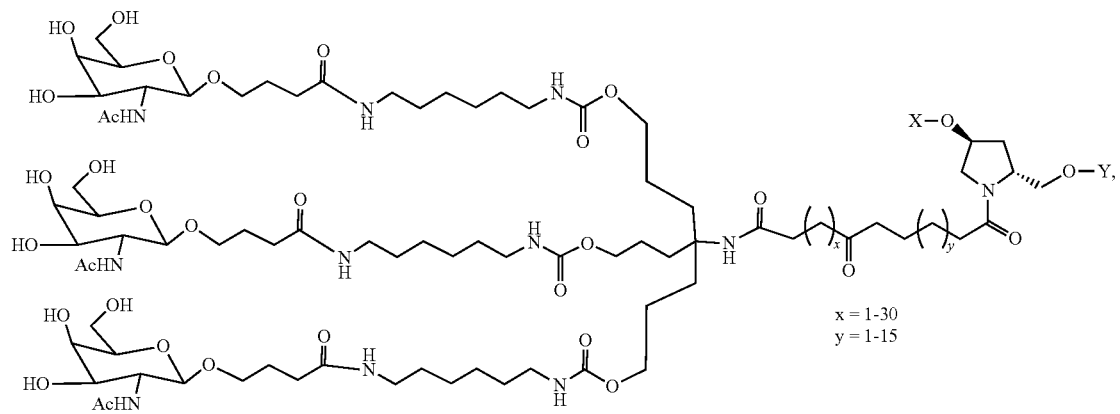
x = 1-30
y = 1-15
(Formula XL)
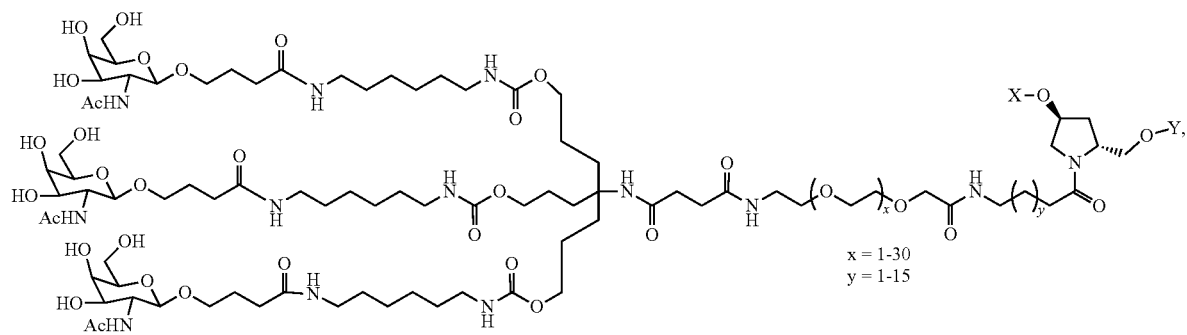
x = 1-30
y = 1-15
(Formula XLI)
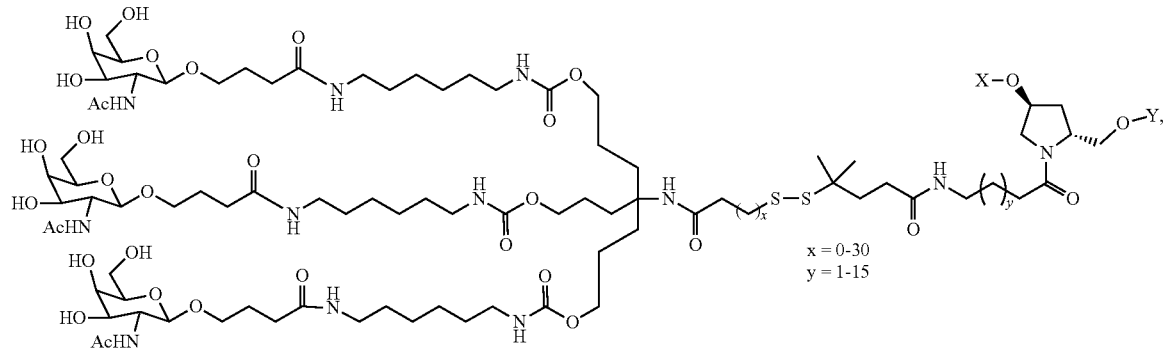
x = 0-30
y = 1-15

-continued (Formula XLII)
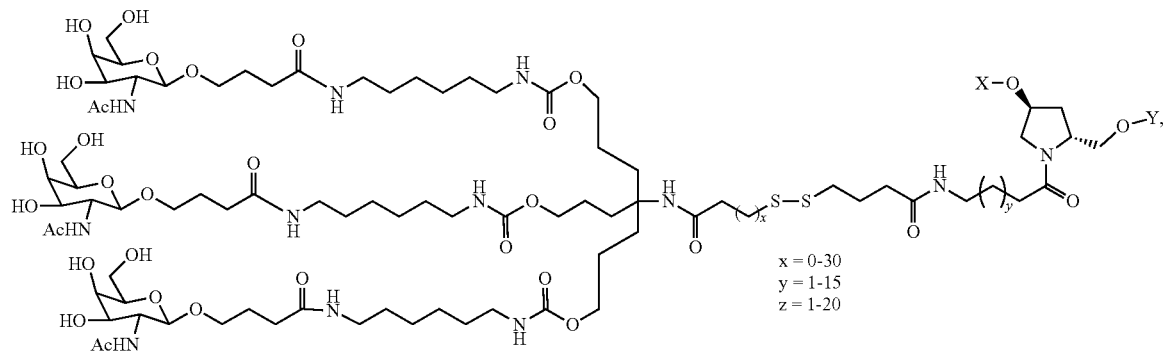

(Formula XLIII)
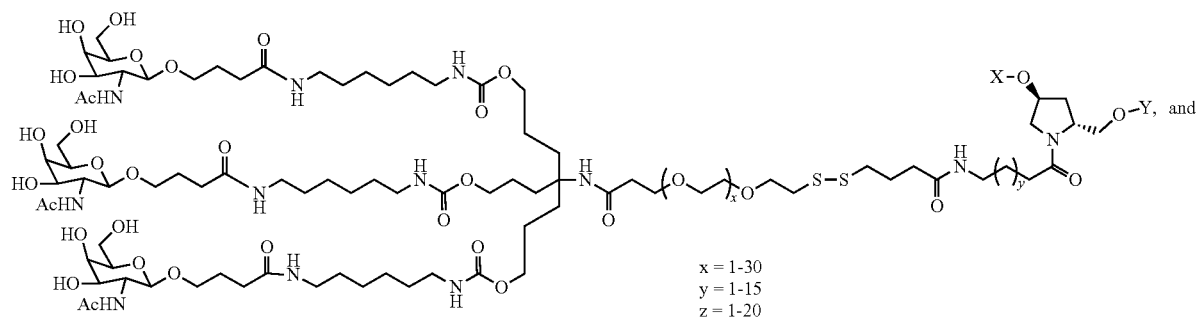

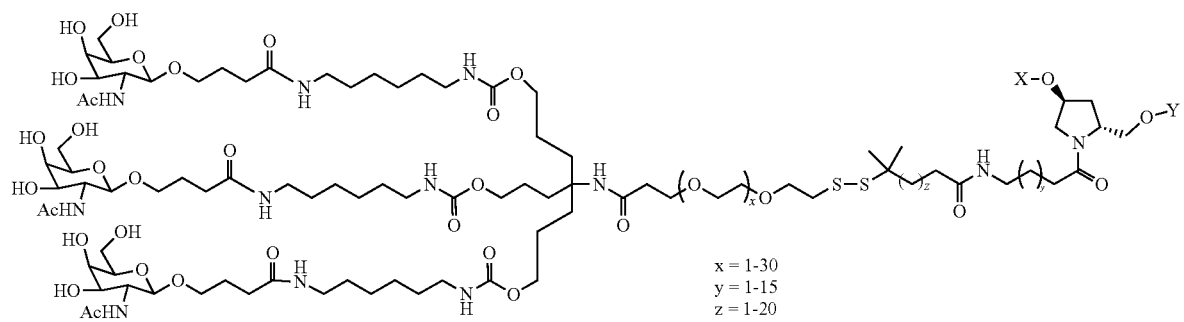

(Formula XLIV), when one of X or Y is an oligonucleotide, the other is a hydrogen.

In certain embodiments of the compositions and methods of the invention, a ligand is one or more "GalNAc" (N-acetylgalactosamine) derivatives attached through a bivalent or trivalent branched linker.

In one embodiment, a dsRNA of the invention is conjugated to a bivalent or trivalent branched linker selected from the group of structures shown in any of formula (XLV)-(XLVIII):

-continued

Formula XLVI
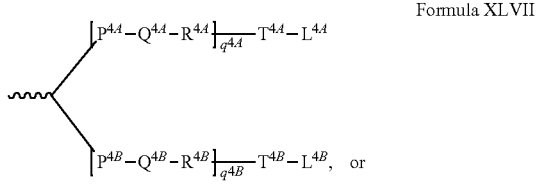

Formula XLV
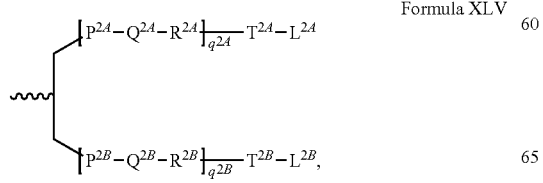

Formula XLVII

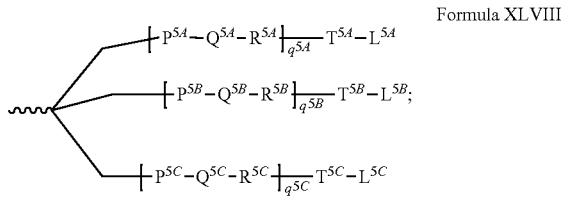

Formula XLVIII wherein:

q2A, q2B, q3A, q3B, q4A, q4B, q5A, q5B and q5C represent independently for each occurrence 0-20 and wherein the repeating unit can be the same or different; $P^{2A}$, $P^{2B}$, $P^{3A}$, $P^{3B}$, $P^{4A}$, $P^{4B}$, $P^{5A}$, $P^{5B}$, $P^{5C}$, $T^{2A}$, $T^{2B}$, $T^{3A}$, $T^{3B}$, $T^{4A}$, $T^{4B}$, $T^{4A}$, $T^{5B}$, are each independently for each occurrence absent, CO, NH, O, S, OC(O), NHC(O), $CH_2$, $CH_2NH$ or $CH_2O$;

$Q^{2A}$, $Q^{2B}$, $Q^{3A}$, $Q^{3B}$, $Q^{4A}$, $Q^{4B}$, $Q^{5A}$, $Q^{5B}$, $Q^{5C}$ are independently for each occurrence absent, alkylene, substituted alkylene wherein one or more methylenes can be interrupted or terminated by one or more of O, S, S(O), $SO_2$, N(R N), C(R')=C(R"), C≡C or C(O);

$R^{2A}$, $R^{2B}$, $R^{3A}$, $R^{3B}$, $R^{4A}$, $R^{4B}$, $R^{5A}$, $R^{5B}$, $R^{5C}$ are each independently for each occurrence absent, NH, O, S, $CH_2$, C(O)O, C(O)NH, NHCH($R^a$)C(O), —C(O)—CH($R^a$)—NH—, CO, CH=N—O,

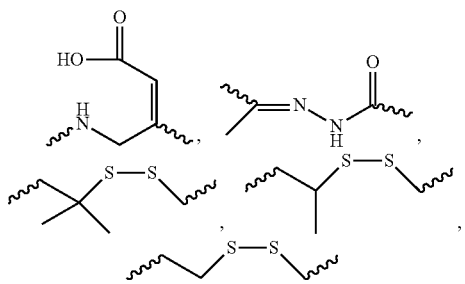

or heterocyclyl; $L^{2A}$, $L^{2B}$, $L^{3A}$, $L^{3B}$, $L^{4A}$, $L^{4B}$, $L^{5A}$, $L^{5B}$ and $L^{5C}$ represent the ligand; i.e. each independently for each occurrence a monosaccharide (such as GalNAc), disaccharide, trisaccharide, tetrasaccharide, oligosaccharide, or polysaccharide; and R a is H or amino acid side chain. Trivalent conjugating GalNAc derivatives are particularly useful for use with RNAi agents for inhibiting the expression of a target gene, such as those of formula (XLIX):

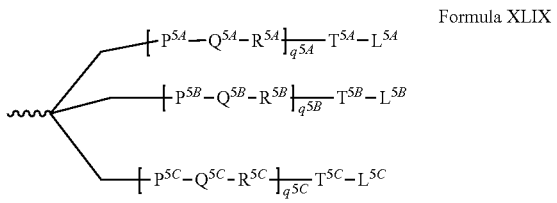

Formula XLIX wherein $L^{5A}$, $L^{5B}$ and $L^{5C}$ represent a monosaccharide, such as GalNAc derivative.

Examples of suitable bivalent and trivalent branched linker groups conjugating GalNAc derivatives include, but are not limited to, the structures recited above as formulas II, VII, XI, X, and XIII.

Representative U.S. Patents that teach the preparation of RNA conjugates include, but are not limited to, U.S. Pat. Nos. 4,828,979; 4,948,882; 5,218,105; 5,525,465; 5,541,313; 5,545,730; 5,552,538; 5,578,717; 5,580,731; 5,591,584; 5,109,124; 5,118,802; 5,138,045; 5,414,077; 5,486,603; 5,512,439; 5,578,718; 5,608,046; 4,587,044; 4,605,735; 4,667,025; 4,762,779; 4,789,737; 4,824,941; 4,835,263; 4,876,335; 4,904,582; 4,958,013; 5,082,830; 5,112,963; 5,214,136; 5,082,830; 5,112,963; 5,214,136; 5,245,022; 5,254,469; 5,258,506; 5,262,536; 5,272,250; 5,292,873; 5,317,098; 5,371,241, 5,391,723; 5,416,203, 5,451,463; 5,510,475; 5,512,667; 5,514,785; 5,565,552; 5,567,810; 5,574,142; 5,585,481; 5,587,371; 5,595,726; 5,597,696; 5,599,923; 5,599,928; 5,688,941; 6,294,664; 6,320,017; 6,576,752; 6,783,931; 6,900,297; 7,037,646; and 8,106,022, the entire contents of each of which are hereby incorporated herein by reference.

It is not necessary for all positions in a given compound to be uniformly modified, and in fact more than one of the aforementioned modifications can be incorporated in a single compound or even at a single nucleoside within an iRNA. The present invention also includes iRNA compounds that are chimeric compounds.

"Chimeric" iRNA compounds or "chimeras," in the context of this invention, are iRNA compounds, such as, dsRNAi agents, that contain two or more chemically distinct regions, each made up of at least one monomer unit, i.e., a nucleotide in the case of a dsRNA compound. These iRNAs typically contain at least one region wherein the RNA is modified so as to confer upon the iRNA increased resistance to nuclease degradation, increased cellular uptake, or increased binding affinity for the target nucleic acid. An additional region of the iRNA can serve as a substrate for enzymes capable of cleaving RNA:DNA or RNA:RNA hybrids. By way of example, RNase H is a cellular endonuclease which cleaves the RNA strand of an RNA:DNA duplex. Activation of RNase H, therefore, results in cleavage of the RNA target, thereby greatly enhancing the efficiency of iRNA inhibition of gene expression. Consequently, comparable results can often be obtained with shorter iRNAs when chimeric dsRNAs are used, compared to phosphorothioate deoxy dsRNAs hybridizing to the same target region. Cleavage of the RNA target can be routinely detected by gel electrophoresis and, if necessary, associated nucleic acid hybridization techniques known in the art.

In certain instances, the RNA of an iRNA can be modified by a non-ligand group. A number of non-ligand molecules have been conjugated to iRNAs in order to enhance the activity, cellular distribution or cellular uptake of the iRNA, and procedures for performing such conjugations are available in the scientific literature. Such non-ligand moieties have included lipid moieties, such as cholesterol (Kubo, T. et al., *Biochem. Biophys. Res. Comm.*, 2007, 365(1):54-61; Letsinger et al., *Proc. Natl. Acad. Sci. USA*, 1989, 86:6553), cholic acid (Manoharan et al., *Bioorg. Med. Chem. Lett.*, 1994, 4:1053), a thioether, e.g., hexyl-S-tritylthiol (Manoharan et al., *Ann. N.Y. Acad. Sci.*, 1992, 660:306; Manoharan et al., *Bioorg. Med. Chem. Let.*, 1993, 3:2765), a thiocholesterol (Oberhauser et al., *Nucl. Acids Res.*, 1992, 20:533), an aliphatic chain, e.g., dodecandiol or undecyl residues (Saison-Behmoaras et al., *EMBO J.*, 1991, 10:111; Kabanov et al., *FEBS Lett.*, 1990, 259:327; Svinarchuk et al., *Biochimie*, 1993, 75:49), a phospholipid, e.g., di-hexadecyl-rac-glycerol or triethylammonium 1,2-di-O-hexadecyl-rac-glycero-3-H-phosphonate (Manoharan et al., *Tetrahedron Lett.*, 1995, 36:3651; Shea et al., *Nucl. Acids Res.*, 1990, 18:3777), a polyamine or a polyethylene glycol chain (Manoharan et al., *Nucleosides & Nucleotides*, 1995, 14:969), or adamantane acetic acid (Manoharan et al., *Tetrahedron Lett.*, 1995, 36:3651), a palmityl moiety (Mishra et al., *Biochim. Biophys. Acta*, 1995, 1264:229), or an octadecylamine or hexylamino-carbonyl-oxycholesterol moiety (Crooke et al., *J. Pharmacol. Exp. Ther.*, 1996, 277:923). Representative United States patents that teach the preparation of such RNA conjugates have been listed above. Typical conjugation protocols involve the synthesis of RNAs bearing an aminolinker at one or more positions of the sequence. The amino group is then reacted with the molecule being conjugated using appropriate coupling or activating reagents. The conjugation reaction can be performed either with the RNA still bound to the solid support or following cleavage of the RNA, in solution phase. Purification of the RNA conjugate by HPLC typically affords the pure conjugate.

IV. Delivery of an iRNA of the Invention

The delivery of an iRNA of the invention to a cell e.g., a cell within a subject, such as a human subject (e.g., a subject in need thereof, such as a subject susceptible to or diagnosed with aN F12-associated disorder, e.g., heredity angioedema (HAE) (e.g., hereditary angioedema type I; hereditary angioedema type II; hereditary angioedema type III; or any other hereditary angioedema caused by elevated levels of bradykinin); prekallikrein deficiency, hypertension, e.g., malignant essential hypertension, end stage renal disease, Fletcher Factor Deficiency, thromboembolic disease, inflammatory disease, or Alzheimer's Disease) can be achieved in a number of different ways. For example, delivery may be performed by contacting a cell with an iRNA of the invention either in vitro or in vivo. In vivo delivery may also be performed directly by administering a composition comprising an iRNA, e.g., a dsRNA, to a subject. Alternatively, in vivo delivery may be performed indirectly by administering one or more vectors that encode and direct the expression of the iRNA. These alternatives are discussed further below.

In general, any method of delivering a nucleic acid molecule (in vitro or in vivo) can be adapted for use with an iRNA of the invention (see e.g., Akhtar S. and Julian RL. (1992) *Trends Cell. Biol.* 2(5):139-144 and WO94/02595, which are incorporated herein by reference in their entireties). For in vivo delivery, factors to consider in order to deliver an iRNA molecule include, for example, biological stability of the delivered molecule, prevention of nonspecific effects, and accumulation of the delivered molecule in the target tissue. RNA interference has also shown success with local delivery to the CNS by direct injection (Dorn, G., et al. (2004) *Nucleic Acids* 32:e49; Tan, P H., et al (2005) *Gene Ther.* 12:59-66; Makimura, H., et al (2002) *BMC Neurosci.* 3:18; Shishkina, G T., et al (2004) *Neuroscience* 129:521-528; Thakker, E R., et al (2004) *Proc. Natl. Acad. Sci. U.S.A.* 101:17270-17275; Akaneya, Y., et al (2005) *J. Neurophysiol.* 93:594-602). Modification of the RNA or the pharmaceutical carrier can also permit targeting of the iRNA to the target tissue and avoid undesirable off-target effects. iRNA molecules can be modified by chemical conjugation to lipophilic groups such as cholesterol to enhance cellular uptake and prevent degradation. For example, an iRNA directed against ApoB conjugated to a lipophilic cholesterol moiety was injected systemically into mice and resulted in knockdown of apoB mRNA in both the liver and jejunum (Soutschek, J., et al (2004) *Nature* 432:173-178).

In an alternative embodiment, the iRNA can be delivered using drug delivery systems such as a nanoparticle, a dendrimer, a polymer, liposomes, or a cationic delivery system. Positively charged cationic delivery systems facilitate binding of an iRNA molecule (negatively charged) and also enhance interactions at the negatively charged cell membrane to permit efficient uptake of an iRNA by the cell. Cationic lipids, dendrimers, or polymers can either be bound to an iRNA, or induced to form a vesicle or micelle (see e.g., Kim S H, et al (2008) *Journal of Controlled Release* 129(2):107-116) that encases an iRNA. The formation of vesicles or micelles further prevents degradation of the iRNA when administered systemically. Methods for making and administering cationic-iRNA complexes are well within the abilities of one skilled in the art (see e.g., Sorensen, D R, et al (2003) *J. Mol. Biol* 327:761-766; Verma, U N, et al (2003) *Clin. Cancer Res.* 9:1291-1300; Arnold, A S et al (2007) *J. Hypertens.* 25:197-205, which are incorporated herein by reference in their entirety). Some non-limiting examples of drug delivery systems useful for systemic delivery of iRNAs include DOTAP (Sorensen, D R., et al (2003), supra; Verma, U N, et al (2003), supra), "solid nucleic acid lipid particles" (Zimmermann, T S, et al (2006) *Nature* 441:111-114), cardiolipin (Chien, P Y, et al (2005) *Cancer Gene Ther.* 12:321-328; Pal, A, et al (2005) *Int J. Oncol.* 26:1087-1091), polyethyleneimine (Bonnet M E, et al (2008) *Pharm. Res.* August 16 Epub ahead of print; Aigner, A. (2006) *J. Biomed. Biotechnol.* 71659), Arg-Gly-Asp (RGD) peptides (Liu, S. (2006) *Mol. Pharm.* 3:472-487), and polyamidoamines (Tomalia, D A, et al (2007) *Biochem. Soc. Trans.* 35:61-67; Yoo, H., et al (1999) *Pharm. Res.* 16:1799-1804). In some embodiments, an iRNA forms a complex with cyclodextrin for systemic administration. Methods for administration and pharmaceutical compositions of iRNAs and cyclodextrins can be found in U.S. Pat. No. 7,427,605, which is herein incorporated by reference in its entirety. Certain aspects of the instant disclosure relate to a method of reducing the expression of an F12 gene in a cell, comprising contacting said cell with the double-stranded RNAi agent of the disclosure. In one embodiment, the cell is a hepatic cell, optionally a hepatocyte. In one embodiment, the cell is an extrahepatic cell.

A. Vector encoded iRNAs of the Invention iRNA targeting the F12 gene can be expressed from transcription units inserted into DNA or RNA vectors (see, e.g., Couture, A, et al., TIG. (1996), 12:5-10; Skillern, A, et al., *International PCT Publication* No. WO 00/22113, Conrad, International PCT Publication No. WO 00/22114, and Conrad, U.S. Pat. No. 6,054,299). Expression can be transient (on the order of hours to weeks) or sustained (weeks to months or longer), depending upon the specific construct used and the target tissue or cell type. These transgenes can be introduced as a linear construct, a circular plasmid, or a viral vector, which can be an integrating or non-integrating vector. The transgene can also be constructed to permit it to be inherited as an extrachromosomal plasmid (Gassmann, et al., *Proc. Natl. Acad. Sci. USA* (1995) 92:1292).

Viral vector systems which can be utilized with the methods and compositions described herein include, but are not limited to, (a) adenovirus vectors; (b) retrovirus vectors, including but not limited to lentiviral vectors, moloney murine leukemia virus, etc.; (c) adeno-associated virus vectors; (d) herpes simplex virus vectors; (e) SV 40 vectors; (f) polyoma virus vectors; (g) papilloma virus vectors; (h) picornavirus vectors; (i) pox virus vectors such as an orthopox, e.g., vaccinia virus vectors or avipox, e.g. canary pox or fowl pox; and (j) a helper-dependent or gutless adenovirus. Replication-defective viruses can also be advantageous. Different vectors will or will not become incorporated into the cells' genome. The constructs can include viral sequences for transfection, if desired. Alternatively, the construct can be incorporated into vectors capable of episomal replication, e.g. EPV and EBV vectors. Constructs for the recombinant expression of an iRNA will generally require regulatory elements, e.g., promoters, enhancers, etc., to ensure the expression of the iRNA in target cells. Other aspects to consider for vectors and constructs are known in the art.

V. Pharmaceutical Compositions of the Invention

The present invention also includes pharmaceutical compositions and formulations which include the iRNAs of the invention. In one embodiment, provided herein are pharmaceutical compositions containing an iRNA, as described herein, and a pharmaceutically acceptable carrier. The pharmaceutical compositions containing the iRNA are useful for preventing or treating an F12-associated disorder, e.g., heredity angioedema (HAE) (e.g., hereditary angioedema type I; hereditary angioedema type II; hereditary angioedema type III; or any other hereditary angioedema caused by elevated levels of bradykinin); prekallikrein deficiency, hypertension, e.g., malignant essential hypertension, end stage renal disease, Fletcher Factor Deficiency, thromboembolic disease, inflammatory disease, or Alzheimer's Disease.

Such pharmaceutical compositions are formulated based on the mode of delivery. One example is compositions that are formulated for systemic administration via parenteral delivery, e.g., by subcutaneous (SC), intramuscular (IM), or intravenous (IV) delivery. The pharmaceutical compositions of the invention may be administered in dosages sufficient to inhibit expression of an F12 gene.

In some embodiments, the pharmaceutical compositions of the invention are sterile. In another embodiment, the pharmaceutical compositions of the invention are pyrogen free.

The pharmaceutical compositions of the invention may be administered in dosages sufficient to inhibit expression of an F12 gene. In general, a suitable dose of an iRNA of the invention will be in the range of about 0.001 to about 200.0 milligrams per kilogram body weight of the recipient per day, generally in the range of about 1 to 50 mg per kilogram body weight per day. Typically, a suitable dose of an iRNA of the invention will be in the range of about 0.1 mg/kg to about 5.0 mg/kg, such as, about 0.3 mg/kg and about 3.0 mg/kg. A repeat-dose regimen may include administration of a therapeutic amount of iRNA on a regular basis, such as every month, once every 3-6 months, or once a year. In certain embodiments, the iRNA is administered about once per month to about once per six months.

After an initial treatment regimen, the treatments can be administered on a less frequent basis. Duration of treatment can be determined based on the severity of disease.

In other embodiments, a single dose of the pharmaceutical compositions can be long lasting, such that doses are administered at not more than 1, 2, 3, or 4 month intervals. In some embodiments of the invention, a single dose of the pharmaceutical compositions of the invention is administered about once per month. In other embodiments of the invention, a single dose of the pharmaceutical compositions of the invention is administered quarterly (i.e., about every three months). In other embodiments of the invention, a single dose of the pharmaceutical compositions of the invention is administered twice per year (i.e., about once every six months).

The skilled artisan will appreciate that certain factors can influence the dosage and timing required to effectively treat a subject, including but not limited to mutations present in the subject, previous treatments, the general health or age of the subject, and other diseases present. Moreover, treatment of a subject with a prophylactically or therapeutically effective amount, as appropriate, of a composition can include a single treatment or a series of treatments.

The pharmaceutical compositions of the present disclosure can be administered in a number of ways depending upon whether local or systemic treatment is desired and upon the area to be treated. Administration may be topical (including ophthalmic, vaginal, rectal, intranasal, transdermal), oral, or parenteral. Parenteral administration includes intravenous, intraarterial, subcutaneous, intraperitoneal or intramuscular injection or infusion; subdermal, e.g., via an implanted device; or intracranial, e.g., by intraparenchymal, intrathecal or intraventricular, administration.

The iRNA can be delivered in a manner to target a particular tissue, such as the liver.

Pharmaceutical compositions and formulations for topical administration can include transdermal patches, ointments, lotions, creams, gels, drops, suppositories, sprays, liquids and powders. Conventional pharmaceutical carriers, aqueous, powder or oily bases, thickeners and the like can be necessary or desirable. Coated condoms, gloves and the like can also be useful. Suitable topical formulations include those in which the RNAi agents featured in the disclosure are in admixture with a topical delivery agent such as lipids, liposomes, fatty acids, fatty acid esters, steroids, chelating agents and surfactants. Suitable lipids and liposomes include neutral (e.g., dioleoylphosphatidyl DOPE ethanolamine, dimyristoylphosphatidyl choline DMPC, distearolyphosphatidyl choline) negative (e.g., dimyristoylphosphatidyl glycerol DMPG) and cationic (e.g., dioleoyltetramethylaminopropyl DOTAP and dioleoylphosphatidyl ethanolamine DOTMA). RNAi agents featured in the disclosure can be encapsulated within liposomes or can form complexes thereto, in particular to cationic liposomes. Alternatively, RNAi agents can be complexed to lipids, in particular to cationic lipids. Suitable fatty acids and esters include but are not limited to arachidonic acid, oleic acid, eicosanoic acid, lauric acid, caprylic acid, capric acid, myristic acid, palmitic acid, stearic acid, linoleic acid, linolenic acid, dicaprate, tricaprate, monoolein, dilaurin, glyceryl 1-monocaprate, 1-dodecylazacycloheptan-2-one, an acylcarnitine, an acylcholine, or a C1-20 alkyl ester (e.g., isopropylmyristate IPM), monoglyceride, diglyceride or pharmaceutically acceptable salt thereof. Topical formulations are described in detail in U.S. Pat. No. 6,747,014, which is incorporated herein by reference.

In one embodiment, the siRNAs, double stranded RNA agents of the invention, are administered to a cell in a pharmaceutical composition by a topical route of administration. In one embodiment, the pharmaceutical composition may include an siRNA compound mixed with a topical delivery agent. The topical delivery agent can be a plurality of microscopic vesicles. The microscopic vesicles can be liposomes. In some embodiments the liposomes are cationic liposomes.

In another embodiment, the dsRNA agent is admixed with a topical penetration enhancer. In one embodiment, the topical penetration enhancer is a fatty acid. The fatty acid can be arachidonic acid, oleic acid, lauric acid, caprylic acid, capric acid, myristic acid, palmitic acid, stearic acid, linoleic acid, linolenic acid, dicaprate, tricaprate, monolein, dilaurin, glyceryl 1-monocaprate, 1-dodecylazacycloheptan-2-one, an acylcarnitine, an acylcholine, or a C1-10 alkyl ester, monoglyceride, diglyceride or pharmaceutically acceptable salt thereof.

In another embodiment, the topical penetration enhancer is a bile salt. The bile salt can be cholic acid, dehydrocholic acid, deoxycholic acid, glucholic acid, glycholic acid, glycodeoxycholic acid, taurocholic acid, taurodeoxycholic acid, chenodeoxycholic acid, ursodeoxycholic acid, sodium tauro-24,25-dihydro-fusidate, sodium glycodihydrofusidate, polyoxyethylene-9-lauryl ether or a pharmaceutically acceptable salt thereof.

In another embodiment, the penetration enhancer is a chelating agent. The chelating agent can be EDTA, citric acid, a salicyclate, a N-acyl derivative of collagen, laureth-9, an N-amino acyl derivative of a beta-diketone or a mixture thereof.

In another embodiment, the penetration enhancer is a surfactant, e.g., an ionic or nonionic surfactant. The surfactant can be sodium lauryl sulfate, polyoxyethylene-9-lauryl ether, polyoxyethylene-20-cetyl ether, a perfluorchemical emulsion or mixture thereof.

In another embodiment, the penetration enhancer can be selected from a group consisting of unsaturated cyclic ureas, 1-alkyl-alkones, 1-alkenylazacyclo-alakanones, steroidal anti-inflammatory agents and mixtures thereof. In yet another embodiment the penetration enhancer can be a glycol, a pyrrol, an azone, or a terpenes.

In one aspect, the invention features a pharmaceutical composition including an siRNA compound, e.g., a double-stranded siRNA compound, or ssiRNA compound, (e.g., a precursor, e.g., a larger siRNA compound which can be processed into a ssiRNA compound, or a DNA which encodes an siRNA compound, e.g., a double-stranded siRNA compound, or ssiRNA compound, or precursor thereof) in an injectable dosage form. In one embodiment, the injectable dosage form of the pharmaceutical composition includes sterile aqueous solutions or dispersions and sterile powders. In some embodiments the sterile solution can include a diluent such as water; saline solution; fixed oils, polyethylene glycols, glycerin, or propylene glycol.

The iRNA molecules of the invention can be incorporated into pharmaceutical compositions. Such compositions typically include one or more species of iRNA and a pharmaceutically acceptable carrier. As used herein the language "pharmaceutically acceptable carrier" is intended to include any and all solvents, dispersion media, coatings, antibacterial and antifungal agents, isotonic and absorption delaying agents, and the like, compatible with pharmaceutical administration to a cell, e.g., a liver cell. The use of such media and agents for pharmaceutically active substances is well known in the art. Except insofar as any conventional media or agent is incompatible with the active compound, use thereof in the compositions is contemplated. Supplementary active compounds can also be incorporated into the compositions.

Pharmaceutical compositions of the present invention include, but are not limited to, solutions, emulsions, and liposome-containing formulations. These compositions can be generated from a variety of components that include, but are not limited to, preformed liquids, self-emulsifying solids, and self-emulsifying semisolids. Formulations include those that target the liver.

The pharmaceutical formulations of the present invention, which can conveniently be presented in unit dosage form, can be prepared according to conventional techniques well known in the pharmaceutical industry. Such techniques include the step of bringing into association the active ingredients with the pharmaceutical carrier(s) or excipient (s). In general, the formulations are prepared by uniformly and intimately bringing into association the active ingredients with liquid carriers.

A. Additional Formulations i. Emulsions

The compositions of the present invention can be prepared and formulated as emulsions. Emulsions are typically heterogeneous systems of one liquid dispersed in another in the form of droplets usually exceeding 0.1 µm in diameter (see e.g., Ansel's Pharmaceutical Dosage Forms and Drug Delivery Systems, Allen, LV., Popovich NG., and Ansel HC., 2004, Lippincott Williams & Wilkins (8th ed.), New York, NY; Idson, in Pharmaceutical Dosage Forms, Lieberman, Rieger and Banker (Eds.), 1988, Marcel Dekker, Inc., New York, N.Y., volume 1, p. 199; Rosoff, in Pharmaceutical Dosage Forms, Lieberman, Rieger and Banker (Eds.), 1988, Marcel Dekker, Inc., New York, N.Y., Volume 1, p. 245; Block in Pharmaceutical Dosage Forms, Lieberman, Rieger and Banker (Eds.), 1988, Marcel Dekker, Inc., New York, N.Y., volume 2, p. 335; Higuchi et al., in Remington's Pharmaceutical Sciences, Mack Publishing Co., Easton, Pa., 1985, p. 301). Emulsions are often biphasic systems comprising two immiscible liquid phases intimately mixed and dispersed with each other. In general, emulsions can be of either the water-in-oil (w/o) or the oil-in-water (o/w) variety. When an aqueous phase is finely divided into and dispersed as minute droplets into a bulk oily phase, the resulting composition is called a water-in-oil (w/o) emulsion. Alternatively, when an oily phase is finely divided into and dispersed as minute droplets into a bulk aqueous phase, the resulting composition is called an oil-in-water (o/w) emulsion. Emulsions can contain additional components in addition to the dispersed phases, and the active drug which can be present as a solution either in the aqueous phase, oily phase or itself as a separate phase. Pharmaceutical excipients such as emulsifiers, stabilizers, dyes, and anti-oxidants can also be present in emulsions as needed. Pharmaceutical emulsions can also be multiple emulsions that are comprised of more than two phases such as, for example, in the case of oil-in-water-in-oil (o/w/o) and water-in-oil-in-water (w/o/w) emulsions. Such complex formulations often provide certain advantages that simple binary emulsions do not. Multiple emulsions in which individual oil droplets of an o/w emulsion enclose small water droplets constitute a w/o/w emulsion. Likewise a system of oil droplets enclosed in globules of water stabilized in an oily continuous phase provides an o/w/o emulsion.

Emulsions are characterized by little or no thermodynamic stability. Often, the dispersed or discontinuous phase of the emulsion is well dispersed into the external or continuous phase and maintained in this form through the means of emulsifiers or the viscosity of the formulation. Other means of stabilizing emulsions entail the use of emulsifiers that can be incorporated into either phase of the emulsion. Emulsifiers can broadly be classified into four categories: synthetic surfactants, naturally occurring emulsifiers, absorption bases, and finely dispersed solids (see e.g., Ansel's Pharmaceutical Dosage Forms and Drug Delivery Systems, Allen, L V., Popovich N G., and Ansel H C., 2004, Lippincott Williams & Wilkins (8th ed.), New York, NY; Idson, in Pharmaceutical Dosage Forms, Lieberman, Rieger and Banker (Eds.), 1988, Marcel Dekker, Inc., New York, N.Y., volume 1, p. 199).

Synthetic surfactants, also known as surface active agents, have found wide applicability in the formulation of emulsions and have been reviewed in the literature (see e.g., Ansel's Pharmaceutical Dosage Forms and Drug Delivery Systems, Allen, LV., Popovich NG., and Ansel HC., 2004, Lippincott Williams & Wilkins (8th ed.), New York, NY; Rieger, in Pharmaceutical Dosage Forms, Lieberman, Rieger and Banker (Eds.), 1988, Marcel Dekker, Inc., New York, N.Y., volume 1, p. 285; Idson, in Pharmaceutical Dosage Forms, Lieberman, Rieger and Banker (Eds.), Marcel Dekker, Inc., New York, N.Y., 1988, volume 1, p. 199). Surfactants are typically amphiphilic and comprise a hydrophilic and a hydrophobic portion. The ratio of the hydrophilic to the hydrophobic nature of the surfactant has been termed the hydrophile/lipophile balance (HLB) and is a valuable tool in categorizing and selecting surfactants in the preparation of formulations. Surfactants can be classified into different classes based on the nature of the hydrophilic group: nonionic, anionic, cationic, and amphoteric (see e.g., Ansel's Pharmaceutical Dosage Forms and Drug Delivery Systems, Allen, L V., Popovich N G., and Ansel HC., 2004, Lippincott Williams & Wilkins (8th ed.), New York, NY Rieger, in Pharmaceutical Dosage Forms, Lieberman, Rieger and Banker (Eds.), 1988, Marcel Dekker, Inc., New York, N.Y., volume 1, p. 285).

A large variety of non-emulsifying materials are also included in emulsion formulations and contribute to the properties of emulsions. These include fats, oils, waxes, fatty acids, fatty alcohols, fatty esters, humectants, hydrophilic colloids, preservatives, and antioxidants (Block, in Pharmaceutical Dosage Forms, Lieberman, Rieger and Banker (Eds.), 1988, Marcel Dekker, Inc., New York, N.Y., volume 1, p. 335; Idson, in Pharmaceutical Dosage Forms, Lieberman, Rieger and Banker (Eds.), 1988, Marcel Dekker, Inc., New York, N.Y., volume 1, p. 199).

The application of emulsion formulations via dermatological, oral, and parenteral routes, and methods for their manufacture have been reviewed in the literature (see e.g., Ansel's Pharmaceutical Dosage Forms and Drug Delivery Systems, Allen, LV., Popovich NG., and Ansel HC., 2004, Lippincott Williams & Wilkins (8th ed.), New York, NY; Idson, in Pharmaceutical Dosage Forms, Lieberman, Rieger and Banker (Eds.), 1988, Marcel Dekker, Inc., New York, N.Y., volume 1, p. 199).

ii. Microemulsions

In one embodiment of the present invention, the compositions of iRNAs and nucleic acids are formulated as microemulsions. A microemulsion can be defined as a system of water, oil, and amphiphile which is a single optically isotropic and thermodynamically stable liquid solution (see e.g., Ansel's Pharmaceutical Dosage Forms and Drug Delivery Systems, Allen, LV., Popovich NG., and Ansel HC., 2004, Lippincott Williams & Wilkins (8th ed.), New York, NY; Rosoff, in Pharmaceutical Dosage Forms, Lieberman, Rieger and Banker (Eds.), 1988, Marcel Dekker, Inc., New York, N.Y., volume 1, p. 245). Typically microemulsions are systems that are prepared by first dispersing an oil in an aqueous surfactant solution and then adding a sufficient amount of a fourth component, generally an intermediate chain-length alcohol to form a transparent system. Therefore, microemulsions have also been described as thermodynamically stable, isotropically clear dispersions of two immiscible liquids that are stabilized by interfacial films of surface-active molecules (Leung and Shah, in: Controlled Release of Drugs: Polymers and Aggregate Systems, Rosoff, M., Ed., 1989, VCH Publishers, New York, pages 185-215).

iii. Microparticles

An iRNA of the invention may be incorporated into a particle, e.g., a microparticle. Microparticles can be produced by spray-drying, but may also be produced by other methods including lyophilization, evaporation, fluid bed drying, vacuum drying, or a combination of these techniques.

iv. Penetration Enhancers

In one embodiment, the present invention employs various penetration enhancers to effect the efficient delivery of nucleic acids, particularly iRNAs, to the skin of animals Most drugs are present in solution in both ionized and nonionized forms. However, usually only lipid soluble or lipophilic drugs readily cross cell membranes. It has been discovered that even non-lipophilic drugs can cross cell membranes if the membrane to be crossed is treated with a penetration enhancer. In addition to aiding the diffusion of non-lipophilic drugs across cell membranes, penetration enhancers also enhance the permeability of lipophilic drugs.

Penetration enhancers can be classified as belonging to one of five broad categories, i.e., surfactants, fatty acids, bile salts, chelating agents, and non-chelating non-surfactants (see e.g., Malmsten, M. Surfactants and polymers in drug delivery, Informa Health Care, New York, NY, 2002; Lee et al., Critical Reviews in Therapeutic Drug Carrier Systems, 1991, p. 92). Each of the above mentioned classes of penetration enhancers and their use in manufacture of pharmaceutical compositions and delivery of pharmaceutical agents are well known in the art.

v. Excipients

In contrast to a carrier compound, a "pharmaceutical carrier" or "excipient" is a pharmaceutically acceptable solvent, suspending agent, or any other pharmacologically inert vehicle for delivering one or more nucleic acids to an animal. The excipient can be liquid or solid and is selected, with the planned manner of administration in mind, so as to provide for the desired bulk, consistency, etc., when combined with a nucleic acid and the other components of a given pharmaceutical composition. Such agent are well known in the art.

vi. Other Components

The compositions of the present invention can additionally contain other adjunct components conventionally found in pharmaceutical compositions, at their art-established usage levels. Thus, for example, the compositions can contain additional, compatible, pharmaceutically-active materials such as, for example, antipruritics, astringents, local anesthetics or anti-inflammatory agents, or can contain additional materials useful in physically formulating various dosage forms of the compositions of the present invention, such as dyes, flavoring agents, preservatives, antioxidants, opacifiers, thickening agents and stabilizers. However, such materials, when added, should not unduly interfere with the biological activities of the components of the compositions of the present invention. The formulations can be sterilized and, if desired, mixed with auxiliary agents, e.g., lubricants, preservatives, stabilizers, wetting agents, emulsifiers, salts for influencing osmotic pressure, buffers, colorings, flavorings, or aromatic substances, and the like which do not deleteriously interact with the nucleic acid(s) of the formulation.

Aqueous suspensions can contain substances which increase the viscosity of the suspension including, for example, sodium carboxymethylcellulose, sorbitol, or dextran. The suspension can also contain stabilizers.

In some embodiments, pharmaceutical compositions featured in the invention include (a) one or more iRNA and (b) one or more agents which function by a non-iRNA mechanism and which are useful in treating an F12-associated disorder, e.g., heredity angioedema (HAE) (e.g., hereditary angioedema type I; hereditary angioedema type II; hereditary angioedema type III; or any other hereditary angioedema caused by elevated levels of bradykinin); prekallikrein deficiency, hypertension, e.g., malignant essential hypertension, end stage renal disease, Fletcher Factor Deficiency, thromboembolic disease, inflammatory disease, or Alzheimer's Disease.

Toxicity and prophylactic efficacy of such compounds can be determined by standard pharmaceutical procedures in cell cultures or experimental animals, e.g., for determining the LD50 (the dose lethal to 50% of the population) and the ED50 (the dose prophylactically effective in 50% of the population). The dose ratio between toxic and therapeutic effects is the therapeutic index and it can be expressed as the ratio LD50/ED50. Compounds that exhibit high therapeutic indices are preferred.

The data obtained from cell culture assays and animal studies can be used in formulating a range of dosage for use in humans. The dosage of compositions featured herein in the invention lies generally within a range of circulating concentrations that include the ED50, such as, an ED80 or ED90, with little or no toxicity. The dosage can vary within this range depending upon the dosage form employed and the route of administration utilized. For any compound used in the methods featured in the invention, the prophylactically effective dose can be estimated initially from cell culture assays. A dose can be formulated in animal models to achieve a circulating plasma concentration range of the compound or, when appropriate, of the polypeptide product of a target sequence (e.g., achieving a decreased concentration of the polypeptide) that includes the IC50 (i.e., the concentration of the test compound which achieves a half-maximal inhibition of symptoms) or higher levels of inhibition as determined in cell culture. Such information can be used to more accurately determine useful doses in humans. Levels in plasma can be measured, for example, by high performance liquid chromatography.

In addition to their administration, as discussed above, the iRNAs featured in the invention can be administered in combination with other known agents used for the prevention or treatment of an F12-associated disorder, e.g., heredity angioedema (HAE) (e.g., hereditary angioedema type I; hereditary angioedema type II; hereditary angioedema type III; or any other hereditary angioedema caused by elevated levels of bradykinin); prekallikrein deficiency, hypertension, e.g., malignant essential hypertension, end stage renal disease, Fletcher Factor Deficiency, thromboembolic disease, inflammatory disease, or Alzheimer's Disease. In any event, the administering physician can adjust the amount and timing of iRNA administration on the basis of results observed using standard measures of efficacy known in the art or described herein.

VI. Methods for Inhibiting F12 Expression

The present invention also provides methods of inhibiting expression of an F12 gene in a cell. The methods include contacting a cell with an RNAi agent, e.g., double stranded RNA agent, in an amount effective to inhibit expression of F12 in the cell, thereby inhibiting expression of F12 in the cell. In some embodiments of the disclosure, expression of an F12 gene is inhibited preferentially in the liver (e.g., hepatocytes).

Contacting of a cell with an iRNA, e.g., a double stranded RNA agent, may be done in vitro or in vivo. Contacting a cell in vivo with the iRNA includes contacting a cell or group of cells within a subject, e.g., a human subject, with the iRNA. Combinations of in vitro and in vivo methods of contacting a cell are also possible. Contacting a cell may be direct or indirect, as discussed above. Furthermore, contacting a cell may be accomplished via a targeting ligand, including any ligand described herein or known in the art. In some embodiments, the targeting ligand is a carbohydrate moiety, e.g., a GalNAc 3 ligand, or any other ligand that directs the RNAi agent to a site of interest.

The term "inhibiting," as used herein, is used interchangeably with "reducing," "silencing," "downregulating", "suppressing", and other similar terms, and includes any level of inhibition.

The phrase "inhibiting expression of an F12" is intended to refer to inhibition of expression of any F12 gene (such as, e.g., a mouse F12 gene, a rat F12 gene, a monkey F12 gene, or a human F12 gene) as well as variants or mutants of an F12 gene. Thus, the F12 gene may be a wild-type F12 gene, a mutant F12 gene, or a transgenic F12 gene in the context of a genetically manipulated cell, group of cells, or organism.

"Inhibiting expression of an F12 gene" includes any level of inhibition of an F12 gene, e.g., at least partial suppression of the expression of an F12 gene. The expression of the F12 gene may be assessed based on the level, or the change in the level, of any variable associated with F12 gene expression, e.g., F12 mRNA level or F12 protein level. This level may be assessed in an individual cell or in a group of cells, including, for example, a sample derived from a subject.

Inhibition may be assessed by a decrease in an absolute or relative level of one or more variables that are associated with F12 expression compared with a control level. The control level may be any type of control level that is utilized in the art, e.g., a pre-dose baseline level, or a level determined from a similar subject, cell, or sample that is untreated or treated with a control (such as, e.g., buffer only control or inactive agent control).

In some embodiments of the methods of the invention, expression of an F12 gene is inhibited by at least 50%, 55%, 60%, 65%, 70%, 75%, 80%, 85%, 90%, or 95%, or to below the level of detection of the assay. In some embodiments, expression of an F12 gene is inhibited by at least 70%. It is further understood that inhibition of F12 expression in certain tissues, e.g., in liver, without a significant inhibition of expression in other tissues, e.g., brain, may be desirable. In some embodiments, expression level is determined using the assay method provided in Example 2 with a 10 nM siRNA concentration in the appropriate species matched cell line.

In certain embodiments, inhibition of expression in vivo is determined by knockdown of the human gene in a rodent expressing the human gene, e.g., an AAV-infected mouse expressing the human target gene (i.e., F12), e.g., when administered as a single dose, e.g., at 3 mg/kg at the nadir of RNA expression. Knockdown of expression of an endogenous gene in a model animal system can also be determined, e.g., after administration of a single dose at, e.g., 3 mg/kg at the nadir of RNA expression. Such systems are useful when the nucleic acid sequence of the human gene and the model animal gene are sufficiently close such that the human iRNA provides effective knockdown of the model animal gene. RNA expression in liver is determined using the PCR methods provided in Example 2.

Inhibition of the expression of an F12 gene may be manifested by a reduction of the amount of mRNA expressed by a first cell or group of cells (such cells may be present, for example, in a sample derived from a subject) in which an F12 gene is transcribed and which has or have been treated (e.g., by contacting the cell or cells with an iRNA of the invention, or by administering an iRNA of the invention to a subject in which the cells are or were present) such that the expression of an F12 gene is inhibited, as compared to a second cell or group of cells substantially identical to the first cell or group of cells but which has not or have not been so treated (control cell(s) not treated with an iRNA or not treated with an iRNA targeted to the gene of interest). In some embodiments, the inhibition is assessed by the method provided in Example 2 using a 10 nM siRNA concentration in the species matched cell line and expressing the level of mRNA in treated cells as a percentage of the level of mRNA in control cells, using the following formula:

$$\frac{(mRNA \text{ in control cells}) - (mRNA \text{ in treated cells})}{(mRNA \text{ in control cells})} \cdot 100\%$$

In other embodiments, inhibition of the expression of an F12 gene may be assessed in terms of a reduction of a parameter that is functionally linked to F12 gene expression, e.g., F12 protein level in blood or serum from a subject. F12 gene silencing may be determined in any cell expressing F12, either endogenous or heterologous from an expression construct, and by any assay known in the art.

Inhibition of the expression of an F12 protein may be manifested by a reduction in the level of the F12 protein that is expressed by a cell or group of cells or in a subject sample (e.g., the level of protein in a blood sample derived from a subject). As explained above, for the assessment of mRNA suppression, the inhibition of protein expression levels in a treated cell or group of cells may similarly be expressed as a percentage of the level of protein in a control cell or group of cells, or the change in the level of protein in a subject sample, e.g., blood or serum derived therefrom.

A control cell, a group of cells, or subject sample that may be used to assess the inhibition of the expression of an F12 gene includes a cell, group of cells, or subject sample that has not yet been contacted with an RNAi agent of the invention. For example, the control cell, group of cells, or subject sample may be derived from an individual subject (e.g., a human or animal subject) prior to treatment of the subject with an RNAi agent or an appropriately matched population control.

The level of F12 mRNA that is expressed by a cell or group of cells may be determined using any method known in the art for assessing mRNA expression. In one embodiment, the level of expression of F12 in a sample is determined by detecting a transcribed polynucleotide, or portion thereof, e.g., mRNA of the F12 gene. RNA may be extracted from cells using RNA extraction techniques including, for example, using acid phenol/guanidine isothiocyanate extraction (RNAzol B; Biogenesis), RNeasy™ RNA preparation kits (Qiagen®) or PAXgene™ (PreAnalytix™ Switzerland). Typical assay formats utilizing ribonucleic acid hybridization include nuclear run-on assays, RT-PCR, RNase protection assays, northern blotting, in situ hybridization, and microarray analysis.

In some embodiments, the level of expression of F12 is determined using a nucleic acid probe. The term "probe", as used herein, refers to any molecule that is capable of selectively binding to a specific F12. Probes can be synthesized by one of skill in the art, or derived from appropriate biological preparations. Probes may be specifically designed to be labeled. Examples of molecules that can be utilized as probes include, but are not limited to, RNA, DNA, proteins, antibodies, and organic molecules.

Isolated mRNA can be used in hybridization or amplification assays that include, but are not limited to, Southern or northern analyses, polymerase chain reaction (PCR) analyses and probe arrays. One method for the determination of mRNA levels involves contacting the isolated mRNA with a nucleic acid molecule (probe) that can hybridize to F12 mRNA. In one embodiment, the mRNA is immobilized on a solid surface and contacted with a probe, for example by running the isolated mRNA on an agarose gel and transferring the mRNA from the gel to a membrane, such as nitrocellulose. In an alternative embodiment, the probe(s) are immobilized on a solid surface and the mRNA is contacted with the probe(s), for example, in an Affymetrix® gene chip array. A skilled artisan can readily adapt known mRNA detection methods for use in determining the level of F12 mRNA.

An alternative method for determining the level of expression of F12 in a sample involves the process of nucleic acid amplification or reverse transcriptase (to prepare cDNA) of for example mRNA in the sample, e.g., by RT-PCR (the experimental embodiment set forth in Mullis, 1987, U.S. Pat. No. 4,683,202), ligase chain reaction (Barany (1991) *Proc. Natl. Acad. Sci. USA* 88:189-193), self sustained sequence replication (Guatelli et al. (1990) *Proc. Natl. Acad. Sci. USA* 87:1874-1878), transcriptional amplification system (Kwoh et al. (1989) *Proc. Natl. Acad. Sci. USA* 86:1173-1177), Q-Beta Replicase (Lizardi et al. (1988) *Bio/Technology* 6:1197), rolling circle replication (Lizardi et al., U.S. Pat. No. 5,854,033) or any other nucleic acid amplification method, followed by the detection of the amplified molecules using techniques well known to those of skill in the art. These detection schemes are especially useful for the detection of nucleic acid molecules if such molecules are present in very low numbers. In particular aspects of the invention, the level of expression of F12 is determined by quantitative fluorogenic RT-PCR (i.e., the TaqMan™ System). In some embodiments, expression level is determined by the method provided in Example 2 using, e.g., a 10 nM siRNA concentration, in the species matched cell line.

The expression levels of F12 mRNA may be monitored using a membrane blot (such as used in hybridization analysis such as northern, Southern, dot, and the like), or microwells, sample tubes, gels, beads or fibers (or any solid support comprising bound nucleic acids). See U.S. Pat. Nos. 5,770,722, 5,874,219, 5,744,305, 5,677,195 and 5,445,934, which are incorporated herein by reference. The determination of F12 expression level may also comprise using nucleic acid probes in solution.

In some embodiments, the level of mRNA expression is assessed using branched DNA (bDNA) assays or real time PCR (qPCR). The use of these methods is described and exemplified in the Examples presented herein. In some embodiments, expression level is determined by the method provided in Example 2 using a 10 nM siRNA concentration in the species matched cell line.

The level of F12 protein expression may be determined using any method known in the art for the measurement of protein levels. Such methods include, for example, electrophoresis, capillary electrophoresis, high performance liquid chromatography (HPLC), thin layer chromatography (TLC), hyperdiffusion chromatography, fluid or gel precipitin reactions, absorption spectroscopy, a colorimetric assays, spectrophotometric assays, flow cytometry, immunodiffusion (single or double), immunoelectrophoresis, western blotting, radioimmunoassay (RIA), enzyme-linked immunosorbent assays (ELISAs), immunofluorescent assays, electrochemiluminescence assays, and the like.

In some embodiments, the efficacy of the methods of the invention are assessed by a decrease in F12 mRNA or protein level (e.g., in a liver biopsy).

In some embodiments, the efficacy of the methods of the invention can be monitored by detecting or monitoring a reduction in a symptom of an F12-associate disorder, e.g., reduction in edema swelling of the extremities, face, larynx, upper respiratory tract, abdomen, trunk, and genitals, prodrome; laryngeal swelling; nonpruritic rash; nausea; vomiting; or abdominal pain. It is well within the ability of one skilled in the art to monitor efficacy of the methods by measuring any one of such parameters, or any combination of parameters.

In some embodiments of the methods of the invention, the iRNA is administered to a subject such that the iRNA is delivered to a specific site within the subject. The inhibition of expression of F12 may be assessed using measurements of the level or change in the level of F12 mRNA or F12 protein in a sample derived from fluid or tissue from the specific site within the subject (e.g., liver or blood).

As used herein, the terms detecting or determining a level of an analyte are understood to mean performing the steps to determine if a material, e.g., protein, RNA, is present. As used herein, methods of detecting or determining include detection or determination of an analyte level that is below the level of detection for the method used.

VII. Prophylactic and Treatment Methods of the Invention

The present invention also provides methods of using an iRNA of the invention or a composition containing an iRNA of the invention to inhibit expression of F12, thereby preventing or treating an F12-associated disorder, e.g., heredity angioedema (HAE) (e.g., hereditary angioedema type I; hereditary angioedema type II; hereditary angioedema type III; or any other hereditary angioedema caused by elevated levels of bradykinin); prekallikrein deficiency, hypertension, e.g., malignant essential hypertension, end stage renal disease, Fletcher Factor Deficiency, thromboembolic disease, inflammatory disease, or Alzheimer's Disease. In the methods of the invention the cell may be contacted with the siRNA in vitro or in vivo, i.e., the cell may be within a subject.

A cell suitable for treatment using the methods of the invention may be any cell that expresses an F12 gene, e.g., a liver cell. A cell suitable for use in the methods of the invention may be a mammalian cell, e.g., a primate cell (such as a human cell, including human cell in a chimeric non-human animal, or a non-human primate cell, e.g., a monkey cell or a chimpanzee cell), or a non-primate cell. In certain embodiments, the cell is a human cell, e.g., a human liver cell. In the methods of the invention, F12 expression is inhibited in the cell by at least 50, 55, 60, 65, 70, 75, 80, 85, 90, or 95, or to a level below the level of detection of the assay.

The in vivo methods of the invention may include administering to a subject a composition containing an iRNA, where the iRNA includes a nucleotide sequence that is complementary to at least a part of an RNA transcript of the F12 gene of the mammal to which the RNAi agent is to be administered. The composition can be administered by any means known in the art including, but not limited to oral, intraperitoneal, or parenteral routes, including intracranial (e.g., intraventricular, intraparenchymal, and intrathecal), intravenous, intramuscular, subcutaneous, transdermal, airway (aerosol), nasal, rectal, intraocular (e.g., periocular, conjunctival, subtenon, intracameral, intravitreal, intraocular, anterior or posterior juxtascleral, subretinal, subconjunctival, retrobulbar, or intracanalicular injection), intravenous, intramuscular, subcutaneous, transdermal, airway (aerosol), and topical (including buccal and sublingual) administration.

In certain embodiments, the compositions are administered by intravenous infusion or injection. In certain embodiments, the compositions are administered by subcutaneous injection. In certain embodiments, the compositions are administered by intramuscular injection.

The mode of administration may be chosen based upon whether local or systemic treatment is desired and based upon the area to be treated. The route and site of administration may be chosen to enhance targeting.

In one aspect, the present invention also provides methods for inhibiting the expression of an F12 gene in a mammal. The methods include administering to the mammal a composition comprising a dsRNA that targets an F12 gene in a cell of the mammal and maintaining the mammal for a time sufficient to obtain degradation of the mRNA transcript of the F12 gene, thereby inhibiting expression of the F12 gene in the cell. Reduction in gene expression can be assessed by any methods known in the art and by methods, e.g. qRT-PCR, described herein, e.g., in Example 2. Reduction in protein production can be assessed by any methods known it the art, e.g. ELISA. In certain embodiments, a puncture liver biopsy sample serves as the tissue material for monitoring the reduction in the F12 gene or protein expression. In other embodiments, a blood sample serves as the subject sample for monitoring the reduction in the F12 protein expression.

The present invention further provides methods of treatment in a subject in need thereof, e.g., a subject diagnosed with an F12-associated disorder, such as heredity angioedema (HAE) (e.g., hereditary angioedema type I; hereditary angioedema type II; hereditary angioedema type III; or any other hereditary angioedema caused by elevated levels of bradykinin); prekallikrein deficiency, hypertension, e.g., malignant essential hypertension, end stage renal disease, Fletcher Factor Deficiency, thromboembolic disease, inflammatory disease, or Alzheimer's Disease.

The present invention further provides methods of prophylaxis in a subject in need thereof. The treatment methods of the invention include administering an iRNA of the invention to a subject, e.g., a subject that would benefit from a reduction of F12 expression, in a prophylactically effective amount of a dsRNA targeting an F12 gene or a pharmaceutical composition comprising a dsRNA targeting an F12 gene.

In one aspect, the present invention provides methods of treating a subject having a disorder that would benefit from reduction in F12 expression, e.g., an F12-associated disorder, such as heredity angioedema (HAE) (e.g., hereditary angioedema type I; hereditary angioedema type II; hereditary angioedema type III; or any other hereditary angioedema caused by elevated levels of bradykinin); prekallikrein deficiency, hypertension, e.g., malignant essential hypertension, end stage renal disease, Fletcher Factor Deficiency, thromboembolic disease, inflammatory disease, or Alzheimer's Disease. Treatment of a subject that would benefit from a reduction and/or inhibition of F12 gene expression includes therapeutic treatment (e.g., a subject is having an F12-associated disorder) and prophylactic treatment (e.g., the subject is not having an F12-associated disorder or a subject may be at risk of developing an F12-associated disorder).

In some embodiments, the F12-associated disorder is selected from the group consisting of heredity angioedema (HAE) (e.g., hereditary angioedema type I; hereditary angioedema type II; hereditary angioedema type III; or any other hereditary angioedema caused by elevated levels of bradykinin); prekallikrein deficiency, hypertension, e.g., malignant essential hypertension, end stage renal disease, Fletcher Factor Deficiency, thromboembolic disease, inflammatory disease, and Alzheimer's Disease.

In some embodiments, the F12-associated disorder is HAE.

In other embodiments, the F12-associated disorder is prekallikrein deficiency.

In other embodiments, the F12-associated disorder is hypertension, e.g., malignant essential hypertension.

In other embodiments, the F12-associated disorder is end stage renal disease.

In other embodiments, the F12-associated disorder is Fletcher Factor Deficiency.

In another embodiment, an F12-associated disorder is thromboembolic disease.

In another embodiment, an F12-associated disorder is inflammatory disease.

In another embodiment, an F12-associated disorder is Alzheimer's Disease.

In some embodiments, the RNAi agent is administered to a subject in an amount effective to inhibit F12 expression in a cell within the subject. The amount effective to inhibit F12 expression in a cell within a subject may be assessed using methods discussed above, including methods that involve assessment of the inhibition of F12 mRNA, F12 protein, or related variables, such as a reduction in the severity of a symptom of an F12-associate disorder, e.g., reduction in the severity of edema swelling of the extremities, face, larynx, upper respiratory tract, abdomen, trunk, and genitals, prodrome; laryngeal swelling; nonpruritic rash; nausea; vomiting; or abdominal pain.

An iRNA of the invention may be administered as a "free iRNA." A free iRNA is administered in the absence of a pharmaceutical composition. The naked iRNA may be in a suitable buffer solution. The buffer solution may comprise acetate, citrate, prolamine, carbonate, or phosphate, or any combination thereof. In one embodiment, the buffer solution is phosphate buffered saline (PBS). The pH and osmolarity of the buffer solution containing the iRNA can be adjusted such that it is suitable for administering to a subject.

Alternatively, an iRNA of the invention may be administered as a pharmaceutical composition, such as a dsRNA liposomal formulation.

Subjects that would benefit from an inhibition of F12 gene expression are subjects susceptible to or diagnosed with an F12-associated disorder, such as heredity angioedema (HAE) (e.g., hereditary angioedema type I; hereditary angioedema type II; hereditary angioedema type III; or any other hereditary angioedema caused by elevated levels of bradykinin); prekallikrein deficiency, hypertension, e.g., malignant essential hypertension, end stage renal disease, Fletcher Factor Deficiency, thromboembolic disease, inflammatory disease, or Alzheimer's Disease. In an embodiment, the method includes administering a composition featured herein such that expression of the target ab F12 gene is decreased, such as for about 1, 2, 3, 4, 5, 6, 1-6, 1-3, or 3-6 months per dose. In certain embodiments, the composition is administered once every 3-6 months.

In one embodiment, the iRNAs useful for the methods and compositions featured herein specifically target RNAs (primary or processed) of the target F12 gene. Compositions and methods for inhibiting the expression of these genes using iRNAs can be prepared and performed as described herein.

Administration of the iRNA according to the methods of the invention may result prevention or treatment of an F12-associated disorder, e.g., heredity angioedema (HAE) (e.g., hereditary angioedema type I; hereditary angioedema type II; hereditary angioedema type III; or any other hereditary angioedema caused by elevated levels of bradykinin); prekallikrein deficiency, hypertension, e.g., malignant essential hypertension, end stage renal disease, Fletcher Factor Deficiency, thromboembolic disease, inflammatory disease, or Alzheimer's Disease. Subjects can be administered a therapeutic amount of iRNA, such as about 0.01 mg/kg to about 200 mg/kg.

In one embodiment, the iRNA is administered subcutaneously, i.e., by subcutaneous injection. One or more injections may be used to deliver the desired dose of iRNA to a subject. The injections may be repeated over a period of time.

The administration may be repeated on a regular basis. In certain embodiments, after an initial treatment regimen, the treatments can be administered on a less frequent basis. A repeat-dose regimen may include administration of a therapeutic amount of iRNA on a regular basis, such as once per month to once a year. In certain embodiments, the iRNA is administered about once per month to about once every three months, or about once every three months to about once every six months.

The invention further provides methods and uses of an iRNA agent or a pharmaceutical composition thereof for treating a subject that would benefit from reduction and/or inhibition of F12 gene expression, e.g., a subject having an F12-associated disorder, in combination with other pharmaceuticals and/or other therapeutic methods, e.g., with known pharmaceuticals and/or known therapeutic methods, such as, for example, those which are currently employed for treating these disorders.

Accordingly, in some aspects of the invention, the methods which include administration of an iRNA agent of the invention, further include administering to the subject one or more additional therapeutic agents. For example, in certain embodiments, an iRNA targeting F12 is administered in combination with, e.g., an agent useful in treating an F12-associated disorder. Exemplary additional therapeutics and treatments for treating an F12-associated disorder include, an androgen, such as danazol or oxandrolone, Berinert®, Cinryze™, Rhuconest®, Ecallantide, Firazyr®, Kalbitor®, and a combination of any of the foregoing.

The iRNA and additional therapeutic agents may be administered at the same time and/or in the same combination, e.g., parenterally, or the additional therapeutic agent can be administered as part of a separate composition or at separate times and/or by another method known in the art or described herein.

The iRNA agent and an additional therapeutic agent and/or treatment may be administered at the same time and/or in the same combination, e.g., parenterally, or the additional therapeutic agent can be administered as part of a separate composition or at separate times and/or by another method known in the art or described herein.

VIII. Kits

In certain aspects, the instant disclosure provides kits that include a suitable container containing a pharmaceutical formulation of a siRNA compound, e.g., a double-stranded siRNA compound, or siRNA compound, (e.g., a precursor, e.g., a larger siRNA compound which can be processed into a siRNA compound, or a DNA which encodes an siRNA compound, e.g., a double-stranded siRNA compound, or ssiRNA compound, or precursor thereof).

Such kits include one or more dsRNA agent(s) and instructions for use, e.g., instructions for administering a prophylactically or therapeutically effective amount of a dsRNA agent(s). The dsRNA agent may be in a vial or a pre-filled syringe. The kits may optionally further comprise means for administering the dsRNA agent (e.g., an injection device, such as a pre-filled syringe), or means for measuring the inhibition of F12 (e.g., means for measuring the inhibition of F12 mRNA, F12 protein, and/or F12 activity). Such means for measuring the inhibition of F12 may comprise a means for obtaining a sample from a subject, such as, e.g., a plasma sample. The kits of the invention may optionally further comprise means for determining the therapeutically effective or prophylactically effective amount.

In certain embodiments the individual components of the pharmaceutical formulation may be provided in one container, e.g., a vial or a pre-filled syringe. Alternatively, it may be desirable to provide the components of the pharmaceutical formulation separately in two or more containers, e.g., one container for a siRNA compound preparation, and at least another for a carrier compound. The kit may be packaged in a number of different configurations such as one or more containers in a single box. The different components can be combined, e.g., according to instructions provided with the kit.

The components can be combined according to a method described herein, e.g., to prepare and administer a pharmaceutical composition. The kit can also include a delivery device.

This invention is further illustrated by the following examples which should not be construed as limiting. The entire contents of all references, patents and published patent applications cited throughout this application, as well as the informal Sequence Listing and Figures, are hereby incorporated herein by reference.

EXAMPLES

Example 1. iRNA Synthesis

Source of Reagents

Where the source of a reagent is not specifically given herein, such reagent can be obtained from any supplier of reagents for molecular biology at a quality/purity standard for application in molecular biology.

siRNA Design siRNAs targeting the human Factor XII (F12) gene (human NCBI refseqID NM_000505.4, NCBI GeneID: 2161) were designed using custom R and Python scripts. The human NM_000505.4 REFSEQ mRNA, has a length of 2036 bases.

Detailed lists of the unmodified F12 sense and antisense strand nucleotide sequences are shown in Table 2. Detailed lists of the modified F12 sense and antisense strand nucleotide sequences are shown in Table 3.

It is to be understood that, throughout the application, a duplex name without a decimal is equivalent to a duplex name with a decimal which merely references the batch number of the duplex. For example, AD-959917 is equivalent to AD-959917.1.

siRNA Synthesis siRNAs were designed, synthesized, and prepared using methods known in the art.

Briefly, siRNA sequences were synthesized on a 1 μmol scale using a Mermade 192 synthesizer (BioAutomation) with phosphoramidite chemistry on solid supports. The solid support was controlled pore glass (500-1000 Å) loaded with a custom GalNAc ligand (3'-GalNAc conjugates), universal solid support (AM Chemicals), or the first nucleotide of interest. Ancillary synthesis reagents and standard 2-cyanoethyl phosphoramidite monomers (2'-deoxy-2'-fluoro, 2'-O-methyl, RNA, DNA) were obtained from Thermo-Fisher (Milwaukee, WI), Hongene (China), or Chemgenes (Wilmington, MA, USA). Additional phosphoramidite monomers were procured from commercial suppliers, prepared in-house, or procured using custom synthesis from various CMOs. Phosphoramidites were prepared at a concentration of 100 mM in either acetonitrile or 9:1 acetonitrile:DMF and were coupled using 5-Ethylthio-1H-tetrazole (ETT, 0.25 M in acetonitrile) with a reaction time of 400 s. Phosphorothioate linkages were generated using a 100 mM solution of 3-((Dimethylamino-methylidene) amino)-3H-1,2,4-dithiazole-3-thione (DDTT, obtained from Chemgenes (Wilmington, MA, USA)) in anhydrous acetonitrile/pyridine (9:1 v/v). Oxidation time was 5 minutes. All sequences were synthesized with final removal of the DMT group ("DMT-Off").

Upon completion of the solid phase synthesis, solid-supported oligoribonucleotides were treated with 300 μL of Methylamine (40% aqueous) at room temperature in 96 well plates for approximately 2 hours to afford cleavage from the solid support and subsequent removal of all additional base-labile protecting groups. For sequences containing any natural ribonucleotide linkages (2'-OH) protected with a tert-butyl dimethyl silyl (TBDMS) group, a second deprotection step was performed using TEA·3HF (triethylamine trihydrofluoride). To each oligonucleotide solution in aqueous methylamine was added 200 μL of dimethyl sulfoxide (DMSO) and 300 μL TEA·3HF and the solution was incubated for approximately 30 mins at 60° C. After incubation, the plate was allowed to come to room temperature and crude oligonucleotides were precipitated by the addition of 1 mL of 9:1 acetontrile:ethanol or 1:1 ethanol:isopropanol. The plates were then centrifuged at 4° C. for 45 mins and the supernatant carefully decanted with the aid of a multichannel pipette. The oligonucleotide pellet was resuspended in 20 mM NaOAc and subsequently desalted using a HiTrap size exclusion column (5 mL, GE Healthcare) on an Agilent LC system equipped with an autosampler, UV detector, conductivity meter, and fraction collector. Desalted samples were collected in 96 well plates and then analyzed by LC-MS and UV spectrometry to confirm identity and quantify the amount of material, respectively.

Duplexing of single strands was performed on a Tecan liquid handling robot. Sense and antisense single strands were combined in an equimolar ratio to a final concentration of 10 μM in 1× PBS in 96 well plates, the plate sealed, incubated at 100° C. for 10 minutes, and subsequently allowed to return slowly to room temperature over a period of 2-3 hours. The concentration and identity of each duplex was confirmed and then subsequently utilized for in vitro screening assays.

Example 2. In Vitro Screening Methods

Cell Culture and 384-Well Transfections

Primary human hepatocytes (PHH) and primary cynomolgus hepatocytes (PCH) (ATCC, Manassas, VA) are grown to near confluence at 37° C. in an atmosphere of 5% $CO_2$ in Eagle's Minimum Essential Medium (Gibco) supplemented with 10% FBS (ATCC) before being released from the plate by trypsinization. Transfection was carried out by adding 7.5 µl of Opti-MEM plus 0.1 µl of Lipofectamine RNAiMax per well (Invitrogen, Carlsbad CA. cat #13778-150) to 2.5 µl of each siRNA duplex to an individual well in a 384-well plate. The mixture was then incubated at room temperature for 15 minutes. Forty µl of complete growth media without antibiotic containing ~1.5×10$^4$ cells was then added to the siRNA mixture. Cells were incubated for 24 hours prior to RNA purification. Single dose experiments were performed in PHH cels at 10 nM, 1 nM, and 0.1 nM final duplex concentration and in PCH cells at 10 nM, 1 nM, and 0.1 nM final duplex concentration.

Free Uptake Transfection

A subset of the duplexes were also assessed by free uptake. Five µl of each duplex in PBS was combined with 5 µl of OptiMEM and 10,000 freshly thawed primary cynomolgus hepatocytes (BioIVT) resuspended in 45 µl of In Vitro Gro CP media (In Vitro Technologies-Celsis, Baltimore, MD) in each well of a 384 well plate. The mixture was incubated for about 48 hours at 37° C. in an atmosphere of 5% CO2. Single dose experiments were performed at 250 nM, 100 nM, 10 nM, or 1 nM final duplex concentration.

DYNABEADS mRNA Isolation Kit (Invitrogen™, Part #: 610-12)

Cells were lysed in 75 µl of Lysis/Binding Buffer containing 3 µL of beads per well and mixed for 10 minutes on an electrostatic shaker. The washing steps were automated on a Biotek EL406, using a magnetic plate support. Beads were washed (in 90 µL) once in Buffer A, once in Buffer B, and twice in Buffer E, with aspiration steps in between. Following a final aspiration, complete 101 µL RT mixture was added to each well, as described below.

cDNA Synthesis Using ABI High Capacity cDNA Reverse Transcription Kit (Applied Biosystems, Foster City, CA, Cat #4368813)

A master mix of 1 µl 10× Buffer, 0.4 µl 25× dNTPs, 1 µl Random primers, 0.5 µl Reverse Transcriptase, 0.5 µl RNase inhibitor and 6.6 µl of $H_2O$ per reaction was added per well. Plates were sealed, agitated for 10 minutes on an electrostatic shaker, and then incubated at 37 degrees C. for 2 hours. Following this, the plates were agitated at 80 degrees C. for 8 minutes.

Real Time PCR

Two microlitre (µl) of cDNA was added to a master mix containing 0.5 µl of human GAPDH TaqMan Probe (4326317E), 0.5 µl human F12, 2 µl nuclease-free water and 5 µl Lightcycler 480 probe master mix (Roche Cat #04887301001) per well in a 384 well plates (Roche cat #04887301001). Real time PCR was done in a LightCycler480 Real Time PCR system (Roche).

To calculate relative fold change, data were analyzed using the ΔΔCt method and normalized to assays performed with cells transfected with 10 nM AD-1955, or mock transfected cells. $IC_{50}$s were calculated using a 4 parameter fit model using XLFit and normalized to cells transfected with AD-1955 or mock-transfected. The sense and antisense sequences of AD-1955 are: sense: cuuAcGcuGAGuAcuucGAdTsdT (SEQ ID NO:11) and antisense UCGAAGuACUcAGCGuAAGdTsdT (SQE DI NO:12).

The results of the single dose screens of the dsRNA agents listed in Tables 2 and 3 in PHH cells are shown in Table 4.

The results of the single dose transfection screens of the dsRNA agents listed in Tables 2 and 3 in PCH cells are shown in Table 5.

The results of the single dose free uptake screens of the dsRNA agents listed in Tables 2 and 3 in PCH cells are shown in Table 6.

TABLE 1

Abbreviations of nucleotide monomers used in nucleic acid sequence representation. It will be understood that these monomers, when present in an oligonucleotide, are mutually linked by 5'-3'-phosphodiester bonds; and it is understood that when the nucleotide contains a 2'-fluoro modification, then the fluoro replaces the hydroxy at that position in the parent nucleotide (i.e., it is a 2'-deoxy-2'-fluoronucleotide). It is to be further understood that the nucleotide abbreviations in the table omit the 3'-phosphate (i.e., they are 3'-OH) when placed at the 3'-terminal position of an oligonucleotide.

| Abbreviation | Nucleotide(s) |
| --- | --- |
| A | Adenosine-3'-phosphate |
| Ab | beta-L-adenosine-3-phosphate |
| Abs | beta-L-adenosine-3-phosphorothioate |
| Af | 2'-fluoroadenosine-3'-phosphate |
| Afs | 2'-fluoroadenosine-3'-phosphorothioate |
| As | adenosine-3'-phosphorothioate |
| C | cytidine-3'-phosphate |
| Cb | beta-L-cytidine-3-phosphate |
| Cbs | beta-L-cytidine-3'-phosphorothioate |
| Cf | 2'-fluorocytidine-3'-phosphate |
| Cfs | 2'-fluorocytidine-3'-phosphorothioate |
| Cs | cytidine-3'-phosphorothioate |
| G | guanosine-3'-phosphate |
| Gb | beta-L-guanosine-3'-phosphate |
| Gbs | beta-L-guanosine-3'-phosphorothioate |
| Gf | 2'-fluoroguanosine-3'-phosphate |
| Gfs | 2'-fluoroguanosine-3'-phosphorothioate |
| Gs | guanosine-3'-phosphorothioate |
| T | 5'-methyluridine-3'-phosphate |
| Tf | 2'-fluoro-5-methyluridine-3'-phosphate |

TABLE 1-continued

Abbreviations of nucleotide monomers used in nucleic acid sequence representation. It will be understood that these monomers, when present in an oligonucleotide, are mutually linked by 5'-3'-phosphodiester bonds; and it is understood that when the nucleotide contains a 2'-fluoro modification, then the fluoro replaces the hydroxy at that position in the parent nucleotide (i.e., it is a 2'-deoxy-2'-fluoronucleotide). It is to be further understood that the nucleotide abbreviations in the table omit the 3'-phosphate (i.e., they are 3'-OH) when placed at the 3'-terminal position of an oligonucleotide.

| Abbreviation | Nucleotide(s) |
|---|---|
| Tfs | 2'-fluoro-5-methyluridine-3'-phosphorothioate |
| Ts | 5-methyluridine-3'-phosphorothioate |
| U | Uridine-3'-phosphate |
| Uf | 2'-fluorouridine-3'-phosphate |
| Ufs | 2'-fluorouridine-3'-phosphorothioate |
| Us | uridine-3'-phosphorothioate |
| N | any nucleotide, modified or unmodified |
| a | 2'-O-methyladenosine-3'-phosphate |
| as | 2'-O-methyladenosine-3'-phosphorothioate |
| c | 2'-O-methylcytidine-3'-phosphate |
| cs | 2'-O-methylcytidine-3'-phosphorothioate |
| g | 2'-O-methylguanosine-3'-phosphate |
| gs | 2'-O-methylguanosine-3'-phosphorothioate |
| t | 2'-O-methyl-5-methyluridine-3'-phosphate |
| ts | 2'-O-methyl-5-methyluridine-3'-phosphorothioate |
| u | 2'-O-methyluridine-3'-phosphate |
| us | 2'-O-methyluridine-3'-phosphorothioate |
| s | phosphorothioate linkage |
| L10 | N-(cholesterylcarboxamidocaproyl)-4-hydroxyprolinol (Hyp-C6-Chol) |

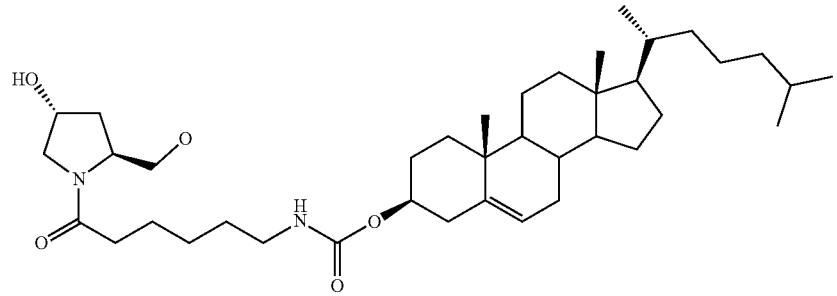 [SMILES: CC(C)CCC[C@@H](C)[C@H]1CCC2C3CC=C4C[C@@H](OC(=O)NCCCCCC(=O)N5C[C@H](O)C[C@H]5CO)CC[C@]4(C)C3CC[C@@]21C]

L96  N-[tris(GalNAc-alkyl)-amidodecanoyl)]-4-hydroxyprolinol
(Hyp-(GalNAc-alkyl)3)
(2S,4R)-1-[29-[[2-(acetylamino)-2-deoxy-ß-D-galactopyranosyl]oxy]-14,14-bis [[3-[[3-[[5-[[2-(acetylamino)-2-deoxy-ß-D-galactopyranosyl]oxy]-1-oxopentyl]amino]propyl]amino]-3-oxopropoxy]methyl]-1,12,19,25-tetraoxo-16-oxa-13,20,24-triazanonacos-1-yl]-4-hydroxy-2-hydroxymethylpyrrolidine

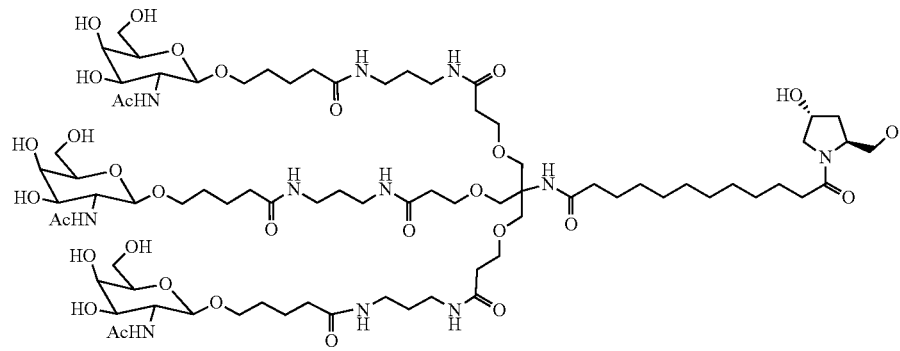 [SMILES: CC(=O)NC1C(OCCCCC(=O)NCCCNC(=O)CCOCC(COCCC(=O)NCCCNC(=O)CCCCOC2OC(CO)C(O)C(O)C2NC(C)=O)(COCCC(=O)NCCCNC(=O)CCCCOC2OC(CO)C(O)C(O)C2NC(C)=O)NC(=O)CCCCCCCCCCC(=O)N2C[C@H](O)C[C@H]2CO)OC(CO)C(O)C1O]

TABLE 1-continued

Abbreviations of nucleotide monomers used in nucleic acid sequence representation. It will be understood that these monomers, when present in an oligonucleotide, are mutually linked by 5'-3'-phosphodiester bonds; and it is understood that when the nucleotide contains a 2'-fluoro modification, then the fluoro replaces the hydroxy at that position in the parent nucleotide (i.e., it is a 2'-deoxy-2'-fluoronucleotide). It is to be further understood that the nucleotide abbreviations in the table omit the 3'-phosphate (i.e., they are 3'-OH) when placed at the 3'-terminal position of an oligonucleotide.

| Abbreviation | Nucleotide(s) |
|---|---|
| uL96 | 2'-O-methyluridine-3'-phosphate ((2S,4R)-1-[29-[[2-(acetylamino)-2-deoxy-ß-D-galactopyranosyl]oxy]-14,14-bis [[3-[3-[[5-[2-(acetylamino)-2-deoxy-ß-D-galactopyranosyl]oxy]-1-oxopentyl]amino]propyl]amino]-3-oxopropoxy]methyl]-1,12,19,25-tetraoxo-16-oxa-13,20,24-triazanonacos-1-yl]-4-hydroxy-2-pyrrolidinyl)methyl ester |

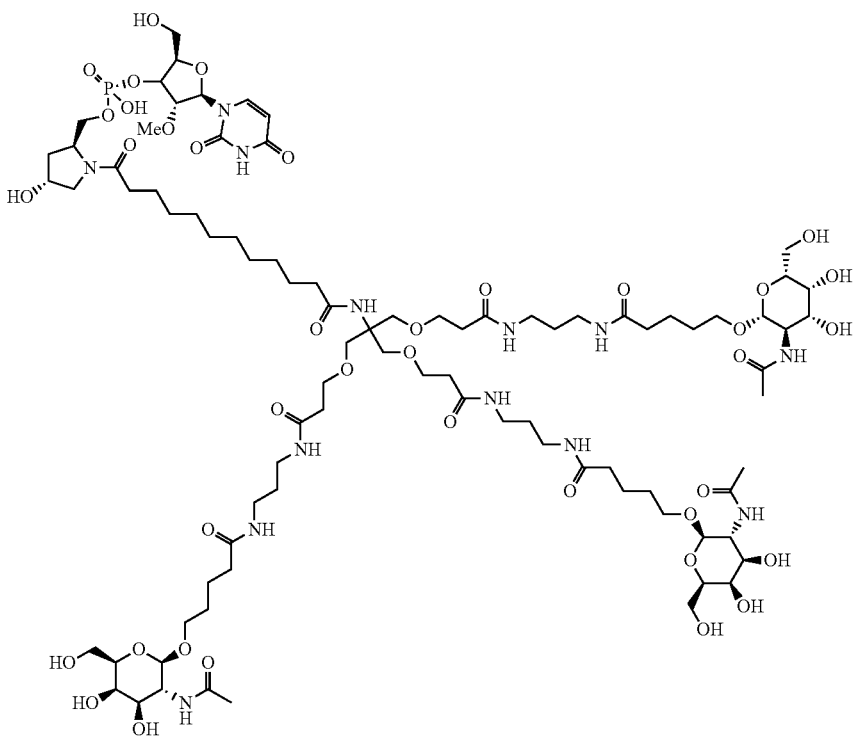 [SMILES: CO[C@@H]1C(O[P@](=O)(O)OC[C@@H]2C[C@@H](O)CN2C(=O)CCCCCCCCCCC(=O)NC(COCCC(=O)NCCCNC(=O)CCCCO[C@@H]2O[C@H](CO)[C@H](O)[C@H](O)[C@H]2NC(C)=O)(COCCC(=O)NCCCNC(=O)CCCCO[C@@H]2O[C@H](CO)[C@H](O)[C@H](O)[C@H]2NC(C)=O)COCCC(=O)NCCCNC(=O)CCCCO[C@@H]2O[C@H](CO)[C@H](O)[C@H](O)[C@H]2NC(C)=O)[C@@H](CO)O[C@H]1n1ccc(=O)[nH]c1=O]

| Y34 | 2-hydroxymethyl-tetrahydrofurane-4-methoxy-3-phosphate (abasic 2'-OMe furanose) |

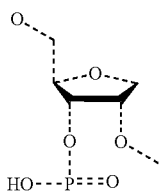

| Y44 | inverted abasic DNA (2-hydroxymethyl-tetrahydrofurane-5-phosphate) |

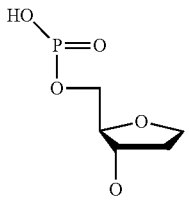

| (Agn) | Adenosine-glycol nucleic acid (GNA) S-Isomer |
| (Cgn) | Cytidine-glycol nucleic acid (GNA) S-Isomer |
| (Ggn) | Guanosine-glycol nucleic acid (GNA) S-Isomer |
| (Tgn) | Thymidine-glycol nucleic acid (GNA) S-Isomer |
| P | Phosphate |

TABLE 1-continued

Abbreviations of nucleotide monomers used in nucleic acid sequence representation. It will be understood that these monomers, when present in an oligonucleotide, are mutually linked by 5'-3'-phosphodiester bonds; and it is understood that when the nucleotide contains a 2'-fluoro modification, then the fluoro replaces the hydroxy at that position in the parent nucleotide (i.e., it is a 2'-deoxy-2'-fluoronucleotide). It is to be further understood that the nucleotide abbreviations in the table omit the 3'-phosphate (i.e., they are 3'-OH) when placed at the 3'-terminal position of an oligonucleotide.

| Abbreviation | Nucleotide(s) |
|---|---|
| VP | Vinyl-phosphonate |
| dA | 2'-deoxyadenosine-3'-phosphate |
| dAs | 2'-deoxyadenosine-3'-phosphorothioate |
| dC | 2'-deoxycytidine-3'-phosphate |
| dCs | 2'-deoxycytidine-3'-phosphorothioate |
| dG | 2'-deoxyguanosine-3'-phosphate |
| dGs | 2'-deoxyguanosine-3'-phosphorothioate |
| dT | 2'-deoxythimidine-3'-phosphate |
| dTs | 2'-deoxythimidine-3'-phosphorothioate |
| dU | 2'-deoxyuridine |
| dUs | 2'-deoxyuridine-3'-phosphorothioate |
| (C2p) | cytidine-2'-phosphate |
| (G2p) | guanosine-2'-phosphate |
| (U2p) | uridine-2'-phosphate |
| (A2p) | adenosine-2'-phosphate |
| (Chd) | 2'-O-hexadecyl-cytidine-3'-phosphate |
| (Ahd) | 2'-O-hexadecyl-adenosine-3'-phosphate |
| (Ghd) | 2'-O-hexadecyl-guanosine-3'-phosphate |
| (Uhd) | 2'-O-hexadecyl-uridine-3'-phosphate |

TABLE 2

Unmodified Sense and Antisense Strand Sequences of F12 dsRNA Agents

| Duplex Name | Sense Strand Sequence 5' to 3' | SEQ ID NO: | Range in NM_000505.4 | Antisense Strand Sequence 5' to 3' | SEQ ID NO: | Range in NM_000505.4 |
|---|---|---|---|---|---|---|
| AD-1534462 | AAAGAGAAGUGCUUUGAGCCU | 21 | 431-451 | AGGCUCAAAGCACUUCUCUUUCU | 285 | 429-451 |
| AD-1534463 | AAAUGUACCCACAAGGGCCGU | 22 | 215-235 | ACGGCCCUUGUGGGUACAUUUGU | 286 | 213-235 |
| AD-1534464 | AACCCGGACAACGACAUCCGU | 23 | 839-859 | ACGGAUGUCGUUGUCCGGGUUCC | 287 | 837-859 |
| AD-1534465 | AACUCAAUAAAGUGCUUUGAU | 24 | 2008-2028 | AUCAAAGCACUUAUUGAGUUCC | 288 | 2006-2028 |
| AD-1534466 | AACUGAGCAAGCAGCUGUGGU | 25 | 493-513 | ACCACAGCUGCUUGCUCAGUUCU | 289 | 491-513 |
| AD-1534467 | AAGAAUGAGAUAUGGUAUAGU | 26 | 473-493 | ACUAUACCAUAUCUCAUUCUUGU | 290 | 471-493 |
| AD-1534468 | AAGAGCACACAGUCGUUCUCU | 27 | 138-158 | AGAGAACGACUGUGUGCUCUUCA | 291 | 136-158 |
| AD-1534469 | AAGCAGCUGUGGCCAGAUGCU | 28 | 501-521 | AGCAUCUGGCCACAGCUGCUUGC | 292 | 499-521 |
| AD-1534470 | AAGCUGCUAUGAUGGCCGCGU | 29 | 682-702 | ACGCGGCCAUCAUAGCAGCUUGC | 293 | 680-702 |
| AD-1534471 | AAGUACAAAGCUGAAGAGCAU | 30 | 125-145 | AUGCUCUUCAGCUUUGUACUUAU | 294 | 123-145 |
| AD-1534472 | AAGUGCUUUGAGCCUCAGCUU | 31 | 437-457 | AAGCUGAGGCUCAAAGCACUUCU | 295 | 435-457 |
| AD-1534473 | AAUAAAGUGCUUUGAAAAUGU | 32 | 2013-2033 | ACAUUUCAAAGCACUUUAUUGA | 296 | 2011-2033 |
| AD-1534474 | ACAAAUGUACCCACAAGGGCU | 33 | 213-233 | AGCCCUUGUGGGUACAUUUGUGG | 297 | 211-233 |
| AD-1534475 | ACACAGUCGUUCUCACUGUCU | 34 | 144-164 | AGACAGTGAGAACGACUGUGUGC | 298 | 142-164 |
| AD-1534476 | ACACCGAUGUGGCCUACUACU | 35 | 1833-1853 | AGUAGUAGGCCACAUCGGUGUAG | 299 | 1831-1853 |
| AD-1534477 | ACACUUUCGAUUCCACCUUGU | 36 | 86-106 | ACAAGGUGGAAUCGAAAGUGUUG | 300 | 84-106 |
| AD-1534478 | ACACUUUCGAUUCCACCUUGU | 37 | 86-106 | ACAAGGUGGAAUCGAAAGUGUUG | 301 | 84-106 |
| AD-1534479 | ACAGUCGUUCUCACUGUCACU | 38 | 146-166 | AGUGACAGUGAGAACGACUGUGU | 302 | 144-166 |
| AD-1534480 | ACAUCGCCGCGCUGUACUGGU | 39 | 1194-1214 | ACCAGUACAGCGCGGCGAUGUAG | 303 | 1192-1214 |
| AD-1534481 | ACCAGCACGACCUGGCUCUGU | 40 | 1410-1430 | ACAGAGCCAGGUCGUGCUGGUAG | 304 | 1408-1430 |

TABLE 2-continued

Unmodified Sense and Antisense Strand Sequences of F12 dsRNA Agents

| Duplex Name | Sense Strand Sequence 5' to 3' | SEQ ID NO: | Range in NM_000505.4 | Antisense Strand Sequence 5' to 3' | SEQ ID NO: | Range in NM_000505.4 |
|---|---|---|---|---|---|---|
| AD-1534482 | ACCCGGACAACGACAUCCGCU | 41 | 840-860 | AGCGGAUGUCGUUGUCCGGGUUC | 305 | 838-860 |
| AD-1534483 | ACCCUGCAAGGCAUCAUCAGU | 42 | 1772-1792 | ACUGAUGAUGCCUUGCAGGGUGA | 306 | 1770-1792 |
| AD-1534484 | ACCGCAACAAGCCAGGCGUCU | 43 | 1812-1832 | AGACGCCUGGCUGUUGCGGUCA | 307 | 1810-1832 |
| AD-1534485 | ACCUGGCUCUGUUGCGCCUUU | 44 | 1419-1439 | AAAGGCGCAACAGAGCCAGGUCG | 308 | 1417-1439 |
| AD-1534486 | ACGUUCAGCCGGUGUGCCUGU | 45 | 1479-1499 | ACAGGCACACCGGCUGAACGUAA | 309 | 1477-1499 |
| AD-1534487 | ACUACCUGGCCUGGAUCCGGU | 46 | 1848-1868 | ACCGGAUCCAGGCCAGGUAGUAG | 310 | 1846-1868 |
| AD-1534488 | ACUCAAUAAAGUGCUUUGAAU | 47 | 2009-2029 | AUUCAAAGCACUUUAUUGAGUUC | 311 | 2007-2029 |
| AD-1534489 | ACUGAGCAAGCAGCUGUGGCU | 48 | 494-514 | AGCCACAGCUGCUUGCUCAGUUC | 312 | 492-514 |
| AD-1534490 | AGAGAAGUGCUUUGAGCCUCU | 49 | 433-453 | AGAGGCUCAAAGCACUUCUCUUU | 313 | 431-453 |
| AD-1534491 | AGAGCACACAGUCGUUCUCAU | 50 | 139-159 | AUGAGAACGACUGUGUGCUCUUC | 314 | 137-159 |
| AD-1534492 | AGAGUCUGUCUUCGAUGACCU | 51 | 1131-1151 | AGGUCAUCGAAGACAGACUCUUG | 315 | 1129-1151 |
| AD-1534493 | AGAUGCCAGUGCAAGGGUCCU | 52 | 515-535 | AGGACCCUUGCACUGGCAUCUGG | 316 | 513-535 |
| AD-1534494 | AGCACGACCUGGCUCUGUUGU | 53 | 1413-1433 | ACAACAGAGCCAGGUCGUGCUGG | 317 | 1411-1433 |
| AD-1534495 | AGCCAGGCGUCUACACCGAUU | 54 | 1821-1841 | AAUCGGUGUAGACGCCUGGCUUG | 318 | 1819-1841 |
| AD-1534496 | AGCCAGGCGUCUACACCGAUU | 55 | 1821-1841 | AAUCGGUGUAGACGCCUGGCUUG | 319 | 1819-1841 |
| AD-1534497 | AGCCCAAGAAAGUGAAAGACU | 56 | 306-326 | AGUCUUUCACUUUCUUGGGCUCC | 320 | 304-326 |
| AD-1534498 | AGCUGAAGAGCACACAGUCGU | 57 | 133-153 | ACGACUGUGUGCUCUUCAGCUUU | 321 | 131-153 |
| AD-1534499 | AGCUGCUAUGAUGGCCGCGGU | 58 | 683-703 | ACCGCGGCCAUCAUAGCAGCUUG | 322 | 681-703 |
| AD-1534500 | AGCUGUACCACAAAUGUACCU | 59 | 204-224 | AGGUACAUUUGUGGUACAGCUGC | 323 | 202-224 |
| AD-1534501 | AGGAGCAUAAGUACAAAGCUU | 60 | 117-137 | AAGCUUUGUACUUAUGCUCCUUG | 324 | 115-137 |
| AD-1534502 | AGGAGCAUAAGUACAAAGCUU | 61 | 117-137 | AAGCUUUGUACUUAUGCUCCUUG | 325 | 115-137 |
| AD-1534503 | AGGAUGGCGCAGGAACUCAAU | 62 | 1995-2015 | AUUGAGUUCCUGCGCCAUCCUGG | 326 | 1993-2015 |
| AD-1534504 | AGGCGUCUACACCGAUGUGGU | 63 | 1825-1845 | ACCACAUCGGUGUAGACGCCUGG | 327 | 1823-1845 |
| AD-1534505 | AGGCUUCAUGUCCCACUCAUU | 64 | 965-985 | AAUGAGUGGGACAUGAAGCCUAG | 328 | 963-985 |
| AD-1534506 | AGUCAACACUUUCGAUUCCAU | 65 | 81-101 | AUGGAAUCGAAAGUGUUGACUCC | 329 | 79-101 |
| AD-1534507 | AGUCAACACUUUCGAUUCCAU | 66 | 81-101 | AUGGAAUCGAAAGUGUUGACUCC | 330 | 79-101 |
| AD-1534508 | AUAAAGUGCUUUGAAAAUGCU | 67 | 2014-2034 | AGCAUUUUCAAAGCACUUUAUUG | 331 | 2012-2034 |
| AD-1534509 | AUCCGCCCGUGGUGCUUCGUU | 68 | 854-874 | AACGAAGCACCACGGGCGGAUGU | 332 | 852-874 |
| AD-1534510 | AUCGGGCUGUGGUGACCGCAU | 69 | 1798-1818 | AUGCGGUCACCACAGCCCGAUCC | 333 | 1796-1818 |
| AD-1534511 | AUGCCAGUGCAAGGGUCCUGU | 70 | 517-537 | ACAGGACCCUUGCACUGGCAUCU | 334 | 515-537 |
| AD-1534512 | AUGCUCUGCGCAGGGUUCCUU | 71 | 1673-1693 | AAGGAACCCUGCGCAGAGCAUGC | 335 | 1671-1693 |
| AD-1534513 | AUGUACCCACAAGGGCCGGCU | 72 | 217-237 | AGCCGGCCCUUGUGGGUACAUUU | 336 | 215-237 |
| AD-1534514 | AUUGCUCAGGGACUCAUCUUU | 73 | 1885-1905 | AAAGAUGAGUCCCUGAGCAAUCA | 337 | 1883-1905 |
| AD-1534515 | CAAAGCUGAAGAGCACACAGU | 74 | 130-150 | ACUGUGUGCUCUUCAGCUUUGUA | 338 | 128-150 |
| AD-1534516 | CAAAUGUACCCACAAGGGCCU | 75 | 214-234 | AGGCCCUUGUGGGUACAUUUGUG | 339 | 212-234 |
| AD-1534517 | CAAGAAAGUGAAAGACCACUU | 76 | 310-330 | AAGUGGUCUUUCACUUUCUUGGG | 340 | 308-330 |
| AD-1534518 | CAAGAGUCUGUCUUCGAUGAU | 77 | 1129-1149 | AUCAUCGAAGACAGACUCUUGCG | 341 | 1127-1149 |

TABLE 2-continued

Unmodified Sense and Antisense Strand Sequences of F12 dsRNA Agents

| Duplex Name | Sense Strand Sequence 5' to 3' | SEQ ID NO: | Range in NM_000505.4 | Antisense Strand Sequence 5' to 3' | SEQ ID NO: | Range in NM_000505.4 |
|---|---|---|---|---|---|---|
| AD-1534519 | CAAGGAGCAUAAGUACAAAGU | 78 | 115-135 | ACUUGUACUUAUGCUCCUUGGG | 342 | 113-135 |
| AD-1534520 | CACAAAUGUACCCACAAGGGU | 79 | 212-232 | ACCCUUGUGGGUACAUUUGUGGU | 343 | 210-232 |
| AD-1534521 | CACCCUGCAAGGCAUCAUCAU | 80 | 1771-1791 | AUGAUGAUGCCUUGCAGGGUGAG | 344 | 1769-1791 |
| AD-1534522 | CACCGAUGUGGCCUACUACCU | 81 | 1834-1854 | AGGUAGUAGGCCACAUCGGUGUA | 345 | 1832-1854 |
| AD-1534523 | CACGACCUGGCUCUGUUGCGU | 82 | 1415-1435 | ACGCAACAGAGCCAGGUCGUGCU | 346 | 1413-1435 |
| AD-1534524 | CACUGUCUCUGUCCACAACAU | 83 | 389-409 | AUGUUGUGGACAGAGACAGUGGG | 347 | 387-409 |
| AD-1534525 | CACUUUCGAUUCCACCUUGGU | 84 | 87-107 | ACCAAGGUGGAAUCGAAAGUGUU | 348 | 85-107 |
| AD-1534526 | CAGAUGCCAGUGCAAGGGUCU | 85 | 514-534 | AGACCCUUGCACUGGCAUCUGGC | 349 | 512-534 |
| AD-1534527 | CAGCACGACCUGGCUCUGUUU | 86 | 1412-1432 | AAACAGAGCCAGGUCGUGCUGGU | 350 | 1410-1432 |
| AD-1534528 | CAGCUGUACCACAAAUGUACU | 87 | 203-223 | AGUACAUUUGUGGUACAGCUGCC | 351 | 201-223 |
| AD-1534529 | CAGCUGUGGCCAGAUGCCAGU | 88 | 504-524 | ACUGGCAUCUGGCCACAGCUGCU | 352 | 502-524 |
| AD-1534530 | CAGGAACUCAAUAAAGUGCUU | 89 | 2004-2024 | AAGCACUUUAUUGAGUUCCUGCG | 353 | 2002-2024 |
| AD-1534531 | CAGGAUGGCGCAGGAACUCAU | 90 | 1994-2014 | AUGAGUUCCUGCGCCAUCCUGGC | 354 | 1992-2014 |
| AD-1534532 | CAGGCGUCUACACCGAUGUGU | 91 | 1824-1844 | ACACAUCGGUGUAGACGCCUGGC | 355 | 1822-1844 |
| AD-1534533 | CAGGGACUCAUCUUUCCCUCU | 92 | 1891-1911 | AGAGGGAAAGAUGAGUCCCUGAG | 356 | 1889-1911 |
| AD-1534534 | CAGUGCAAGGGUCCUGAUGCU | 93 | 521-541 | AGCAUCAGGACCCUUGCACUGGC | 357 | 519-541 |
| AD-1534535 | CCACAAAUGUACCCACAAGGU | 94 | 211-231 | ACCUUGUGGGUACAUUUGUGGUA | 358 | 209-231 |
| AD-1534536 | CCACAAAUGUACCCACAAGGU | 95 | 211-231 | ACCUUGUGGGUACAUUUGUGGUA | 359 | 209-231 |
| AD-1534537 | CCAGAUGCCAGUGCAAGGGUU | 96 | 513-533 | AACCCUUGCACUGGCAUCUGGCC | 360 | 511-533 |
| AD-1534538 | CCAGGCGUCUACACCGAUGUU | 97 | 1823-1843 | AACAUCGGUGUAGACGCCUGGCU | 361 | 1821-1843 |
| AD-1534539 | CCCAAGAAAGUGAAAGACCAU | 98 | 308-328 | AUGGUCUUUCACUUUCUUGGGCU | 362 | 306-328 |
| AD-1534540 | CCCGGACAACGACAUCCGCCU | 99 | 841-861 | AGGCGGAUGUCGUUGUCCGGGUU | 363 | 839-861 |
| AD-1534541 | CCCGGACAACGACAUCCGCCU | 100 | 841-861 | AGGCGGAUGUCGUUGUCCGGGUU | 364 | 839-861 |
| AD-1534542 | CCCUGCAAGGCAUCAUCAGCU | 101 | 1773-1793 | AGCUGAUGAUGCCUUGCAGGGUG | 365 | 1771-1793 |
| AD-1534543 | CCGAUGUGGCCUACUACCUGU | 102 | 1836-1856 | ACAGGUAGUAGGCCACAUCGGUG | 366 | 1834-1856 |
| AD-1534544 | CCGCAACAAGCCAGGCGUCUU | 103 | 1813-1833 | AAGACGCCUGGCUUGUUGCGGUC | 367 | 1811-1833 |
| AD-1534545 | CCGCAAGAGUCUGUCUUCGAU | 104 | 1126-1146 | AUCGAAGACAGACUCUUGCGGAG | 368 | 1124-1146 |
| AD-1534546 | CCGGAACCCGGACAACGACAU | 105 | 835-855 | AUGUCGUUGUCCGGGUUCCGGCA | 369 | 833-855 |
| AD-1534547 | CCGGAACCCGGACAACGACAU | 106 | 835-855 | AUGUCGUUGUCCGGGUUCCGGCA | 370 | 833-855 |
| AD-1534548 | CCUGCAGGAGGCGCAGGUACU | 107 | 1591-1611 | AGUACCUGCGCCUCCUGCAGGAA | 371 | 1589-1611 |
| AD-1534549 | CCUGUCGCCUUACGUUCAGCU | 108 | 1468-1488 | AGCUGAACGUAAGGCGACAGGAG | 372 | 1466-1488 |
| AD-1534550 | CCUGUCGCCUUACGUUCAGCU | 109 | 1468-1488 | AGCUGAACGUAAGGCGACAGGAG | 373 | 1466-1488 |
| AD-1534551 | CCUUACGUUCAGCCGGUGUGU | 110 | 1475-1495 | ACACACCGGCUGAACGUAAGGCG | 374 | 1473-1495 |
| AD-1534552 | CGCAACAAGCCAGGCGUCUAU | 111 | 1814-1834 | AUAGACGCCUGGCUUGUUGCGGU | 375 | 1812-1834 |
| AD-1534553 | CGCAGGAACUCAAUAAAGUGU | 112 | 2002-2022 | ACACUUUAUUGAGUUCCUGCGCC | 376 | 2000-2022 |
| AD-1534554 | CGCCUUACGUUCAGCCGGUGU | 113 | 1473-1493 | ACACCGGCUGAACGUAAGGCGAC | 377 | 1471-1493 |
| AD-1534555 | CGCUCCUGUCGCCUUACGUUU | 114 | 1464-1484 | AAACGUAAGGCGACAGGAGCGCG | 378 | 1462-1484 |

TABLE 2-continued

Unmodified Sense and Antisense Strand Sequences of F12 dsRNA Agents

| Duplex Name | Sense Strand Sequence 5' to 3' | SEQ ID NO: | Range in NM_000505.4 | Antisense Strand Sequence 5' to 3' | SEQ ID NO: | Range in NM_000505.4 |
|---|---|---|---|---|---|---|
| AD-1534556 | CGGAACCCGGACAACGACAUU | 115 | 836-856 | AAUGUCGUUGUCCGGGUUCCGG | 379 | 834-856 |
| AD-1534557 | CGGCUCCGCAAGAGUCUGUCU | 116 | 1121-1141 | AGACAGACUCUUGCGGAGCCGCU | 380 | 1119-1141 |
| AD-1534558 | CGUCUACACCGAUGUGGCCUU | 117 | 1828-1848 | AAGGCCACAUCGGUGUAGACGCC | 381 | 1826-1848 |
| AD-1534559 | CGUGCCAGGGUGAUUCCGGAU | 118 | 1710-1730 | AUCCGGAAUCACCCUGGCACGCA | 382 | 1708-1730 |
| AD-1534560 | CUACAUCGCCGCGCUGUACUU | 119 | 1192-1212 | AAGUACAGCGCGGCGAUGUAGGG | 383 | 1190-1212 |
| AD-1534561 | CUACCUGGCCUGGAUCCGGGU | 120 | 1849-1869 | ACCCGGAUCCAGGCCAGGUAGUA | 384 | 1847-1869 |
| AD-1534562 | CUCAAUAAAGUGCUUUGAAAU | 121 | 2010-2030 | AUUCAAAGCACUUUAUUGAGUU | 385 | 2008-2030 |
| AD-1534563 | CUCAAUAAAGUGCUUUGAAAU | 122 | 2010-2030 | AUUUCAAAGCACUUUAUUGAGUU | 386 | 2008-2030 |
| AD-1534564 | CUCAGGGACUCAUCUUUCCCU | 123 | 1889-1909 | AGGGAAAGAUGAGUCCCUGAGCA | 387 | 1887-1909 |
| AD-1534565 | CUCCUGUCGCCUUACGUUCAU | 124 | 1466-1486 | AUGAACGUAAGGCGACAGGAGCG | 388 | 1464-1486 |
| AD-1534566 | CUCUGUUGCGCCUUCAGGAGU | 125 | 1425-1445 | ACUCCUGAAGGCGCAACAGAGCC | 389 | 1423-1445 |
| AD-1534567 | CUGAAGAGCACACAGUCGUUU | 126 | 135-155 | AAACGACUGUGUGCUCUUCAGCU | 390 | 133-155 |
| AD-1534568 | CUGAUUGCUCAGGGACUCAUU | 127 | 1882-1902 | AAUGAGUCCCUGAGCAAUCAGGA | 391 | 1880-1902 |
| AD-1534569 | CUGCAAGGCAUCAUCAGCUGU | 128 | 1775-1795 | ACAGCUGAUGAUGCCUUGCAGGG | 392 | 1773-1795 |
| AD-1534570 | CUGCCGGAACCCGGACAACGU | 129 | 832-852 | ACGUUGUCCGGGUUCCGGCAGAA | 393 | 830-852 |
| AD-1534571 | CUGUACCACAAAUGUACCCAU | 130 | 206-226 | AUGGGUACAUUUGUGGUACAGCU | 394 | 204-226 |
| AD-1534572 | CUGUCGCCUUACGUUCAGCCU | 131 | 1469-1489 | AGGCUGAACGUAAGGCGACAGGA | 395 | 1467-1489 |
| AD-1534573 | CUGUCUCUGUCCACAACACCU | 132 | 391-411 | AGGUGUGUGGACAGAGACAGUG | 396 | 389-411 |
| AD-1534574 | CUGUGGUGACCGCAACAAGCU | 133 | 1804-1824 | AGCUUGUUGCGGUCACCACAGCC | 397 | 1802-1824 |
| AD-1534575 | CUUACGUUCAGCCGGUGUGCU | 134 | 1476-1496 | AGCACACCGGCUGAACGUAAGGC | 398 | 1474-1496 |
| AD-1534576 | CUUCGAUGACCCGCGUCGUUU | 135 | 1140-1160 | AAACGACGCGGGUCAUCGAAGAC | 399 | 1138-1160 |
| AD-1534577 | CUUGGAGUCAACACUUUCGAU | 136 | 76-96 | AUCGAAAGUGUUGACUCCAAGCU | 400 | 74-96 |
| AD-1534578 | CUUUGAGCCUCAGCUUCUCCU | 137 | 442-462 | AGGAGAAGCUGAGGCUCAAAGCA | 401 | 440-462 |
| AD-1534579 | GAAAGUGAAAGACCACUGCAU | 138 | 313-333 | AUGCAGUGGUCUUUCACUUUCUU | 402 | 311-333 |
| AD-1534580 | GAACCCGGACAACGACAUCCU | 139 | 838-858 | AGGAUGUCGUUGUCCGGGUUCCG | 403 | 836-858 |
| AD-1534581 | GAACUCAAUAAAGUGCUUUGU | 140 | 2007-2027 | ACAAAGCACUUUAUUGAGUUCCU | 404 | 2005-2027 |
| AD-1534582 | GAAGAGCACACAGUCGUUCUU | 141 | 137-157 | AAGAACGACUGUGUGCUCUUCAG | 405 | 135-157 |
| AD-1534583 | GACCGCAACAAGCCAGGCGUU | 142 | 1811-1831 | AACGCCUGGCUUGUUGCGGUCAC | 406 | 1809-1831 |
| AD-1534584 | GAGCACACAGUCGUUCUCACU | 143 | 140-160 | AGUGAGAACGACUGUGUGCUCUU | 407 | 138-160 |
| AD-1534585 | GAGCAUAAGUACAAAGCUGAU | 144 | 119-139 | AUCAGCUUUGUACUUAUGCUCCU | 408 | 117-139 |
| AD-1534586 | GAGCCUCAGCUUCUCCGGUUU | 145 | 446-466 | AAACCGGAGAAGCUGAGGCUCAA | 409 | 444-466 |
| AD-1534587 | GAGUCUGUCUUCGAUGACCCU | 146 | 1132-1152 | AGGGUCAUCGAAGACAGACUCUU | 410 | 1130-1152 |
| AD-1534588 | GAUGCCAGUGCAAGGGUCCUU | 147 | 516-536 | AAGGACCCUUGCACUGGCAUCUG | 411 | 514-536 |
| AD-1534589 | GAUGGCGCAGGAACUCAAUAU | 148 | 1997-2017 | AUAUUGAGUUCCUGCGCCAUCCU | 412 | 1995-2017 |
| AD-1534590 | GAUUGCUCAGGGACUCAUCUU | 149 | 1884-1904 | AAGAUGAGUCCCUGAGCAAUCAG | 413 | 1882-1904 |
| AD-1534591 | GCAAGAGUCUGUCUUCGAUGU | 150 | 1128-1148 | ACAUCGAAGACAGACUCUUGCGG | 414 | 1126-1148 |
| AD-1534592 | GCACACAGUCGUUCUCACUGU | 151 | 142-162 | ACAGUGAGAACGACUGUGUGCUC | 415 | 140-162 |

TABLE 2-continued

Unmodified Sense and Antisense Strand Sequences of F12 dsRNA Agents

| Duplex Name | Sense Strand Sequence 5' to 3' | SEQ ID NO: | Range in NM_000505.4 | Antisense Strand Sequence 5' to 3' | SEQ ID NO: | Range in NM_000505.4 |
|---|---|---|---|---|---|---|
| AD-1534593 | GCACGACCUGGCUCUGUUGCU | 152 | 1414-1434 | AGCAACAGAGCCAGGUCGUGCUG | 416 | 1412-1434 |
| AD-1534594 | GCACGACCUGGCUCUGUUGCU | 153 | 1414-1434 | AGCAACAGAGCCAGGUCGUGCUG | 417 | 1412-1434 |
| AD-1534595 | GCAGCUGUGGCCAGAUGCCAU | 154 | 503-523 | AUGGCATCUGGCCACAGCUGCUU | 418 | 501-523 |
| AD-1534596 | GCAGGAACUCAAUAAAGUGCU | 155 | 2003-2023 | AGCACUUAUUGAGUUCCUGCGC | 419 | 2001-2023 |
| AD-1534597 | GCCAGAUGCCAGUGCAAGGGU | 156 | 512-532 | ACCCUUGCACUGGCAUCUGGCCA | 420 | 510-532 |
| AD-1534598 | GCCAGGCGUCUACACCGAUGU | 157 | 1822-1842 | ACAUCGGUGUAGACGCCUGGCUU | 421 | 1820-1842 |
| AD-1534599 | GCCCAAGAAAGUGAAAGACCU | 158 | 307-327 | AGGUCUUUCACUUUCUUGGGCUC | 422 | 305-327 |
| AD-1534600 | GCCUUACGUUCAGCCGGUGUU | 159 | 1474-1494 | AACACCGGCUGAACGUAAGGCGA | 423 | 1472-1494 |
| AD-1534601 | GCGCAGGAACUCAAUAAAGUU | 160 | 2001-2021 | AACUUAUUGAGUUCCUGCGCCA | 424 | 1999-2021 |
| AD-1534602 | GCGCCUUCAGGAGGAUGCGGU | 161 | 1432-1452 | ACCGCAUCCUCCUGAAGGCGCAA | 425 | 1430-1452 |
| AD-1534603 | GCGGCUCCGCAAGAGUCUGUU | 162 | 1120-1140 | AACAGACUCUUGCGGAGCCGCUG | 426 | 1118-1140 |
| AD-1534604 | GCUCAGGGACUCAUCUUUCCU | 163 | 1888-1908 | AGGAAAGAUGAGUCCCUGAGCAA | 427 | 1886-1908 |
| AD-1534605 | GCUCCGCAAGAGUCUGUCUUU | 164 | 1123-1143 | AAAGACAGACUCUUGCGGAGCCG | 428 | 1121-1143 |
| AD-1534606 | GCUCCUGUCGCCUUACGUUCU | 165 | 1465-1485 | AGAACGUAAGGCGACAGGAGCGC | 429 | 1463-1485 |
| AD-1534607 | GCUCUGCGCAGGGUUCCUCGU | 166 | 1675-1695 | ACGAGGAACCCUGCGCAGAGCAU | 430 | 1673-1695 |
| AD-1534608 | GCUCUGCGCAGGGUUCCUCGU | 167 | 1675-1695 | ACGAGGAACCCUGCGCAGAGCAU | 431 | 1673-1695 |
| AD-1534609 | GCUCUGUUGCGCCUUCAGGAU | 168 | 1424-1444 | ATCCUGAAGGCGCAACAGAGCCA | 432 | 1422-1444 |
| AD-1534610 | GCUCUGUUGCGCCUUCAGGAU | 169 | 1424-1444 | AUCCUGAAGGCGCAACAGAGCCA | 433 | 1422-1444 |
| AD-1534611 | GCUGAAGAGCACACAGUCGUU | 170 | 134-154 | AACGACUGUGUGCUCUUCAGCUU | 434 | 132-154 |
| AD-1534612 | GCUGCUAUGAUGGCCGCGGGU | 171 | 684-704 | ACCCGCGGCCAUCAUAGCAGCUU | 435 | 682-704 |
| AD-1534613 | GCUGGUGUGUGAGGACCAAGU | 172 | 1735-1755 | ACUUGGUCCUCACACACCAGCGG | 436 | 1733-1755 |
| AD-1534614 | GCUGUGGUGACCGCAACAAGU | 173 | 1803-1823 | ACUUGUUGCGGUCACCACAGCCC | 437 | 1801-1823 |
| AD-1534615 | GCUGUGGUGACCGCAACAAGU | 174 | 1803-1823 | ACUUGUUGCGGUCACCACAGCCC | 438 | 1801-1823 |
| AD-1534616 | GCUUCAUGUCCCACUCAUGCU | 175 | 967-987 | AGCAUGAGUGGGACAUGAAGCCU | 439 | 965-987 |
| AD-1534617 | GCUUUGAGCCUCAGCUUCUCU | 176 | 441-461 | AGAGAAGCUGAGGCUCAAAGCAC | 440 | 439-461 |
| AD-1534618 | GGAACUCAAUAAAGUGCUUUU | 177 | 2006-2026 | AAAAGCACUUUAUUGAGUUCCUG | 441 | 2004-2026 |
| AD-1534619 | GGAGCAUAAGUACAAAGCUGU | 178 | 118-138 | ACAGCUUUGUACUUAUGCUCCUU | 442 | 116-138 |
| AD-1534620 | GGAGCCCAAGAAAGUGAAAGU | 179 | 304-324 | ACUUUCACUUUCUUGGGCUCCAA | 443 | 302-324 |
| AD-1534621 | GGAGUCAACACUUUCGAUUCU | 180 | 79-99 | AGAAUCGAAAGUGUUGACUCCAA | 444 | 77-99 |
| AD-1534622 | GGCGUCUACACCGAUGUGGCU | 181 | 1826-1846 | AGCCACAUCGGUGUAGACGCCUU | 445 | 1824-1846 |
| AD-1534623 | GGCGUCUACACCGAUGUGGCU | 182 | 1826-1846 | AGCCACAUCGGUGUAGACGCCUG | 446 | 1824-1846 |
| AD-1534624 | GGCUCCGCAAGAGUCUGUCUU | 183 | 1122-1142 | AAGACAGACUCUUGCGGAGCCGC | 447 | 1120-1142 |
| AD-1534625 | GGCUCUGUUGCGCCUUCAGGU | 184 | 1423-1443 | ACCUGAAGGCGCAACAGAGCCAG | 448 | 1421-1443 |
| AD-1534626 | GGGUCCUGAUGCCCACUGCCU | 185 | 529-549 | AGGCAGUGGGCAUCAGGACCCUU | 449 | 527-549 |
| AD-1534627 | GUCAACACUUUCGAUUCCACU | 186 | 82-102 | AGUGGAAUCGAAAGUGUUGACUC | 450 | 80-102 |
| AD-1534628 | GUCAACACUUUCGAUUCCACU | 187 | 82-102 | AGUGGAAUCGAAAGUGUUGACUC | 451 | 80-102 |
| AD-1534629 | GUCGCCUUACGUUCAGCCGGU | 188 | 1471-1491 | ACCGGCUGAACGUAAGGCGACAG | 452 | 1469-1491 |

TABLE 2-continued

Unmodified Sense and Antisense Strand Sequences of F12 dsRNA Agents

| Duplex Name | Sense Strand Sequence 5' to 3' | SEQ ID NO: | Range in NM_000505.4 | Antisense Strand Sequence 5' to 3' | SEQ ID NO: | Range in NM_000505.4 |
|---|---|---|---|---|---|---|
| AD-1534630 | GUCGCCUUACGUUCAGCCGGU | 189 | 1471-1491 | ACCGGCTGAACGUAAGGCGACAG | 453 | 1469-1491 |
| AD-1534631 | GUCGUUCUCACUGUCACCGGU | 190 | 149-169 | ACCGGTGACAGTGAGAACGACUG | 454 | 147-169 |
| AD-1534632 | GUCUGUCUUCGAUGACCCGCU | 191 | 1134-1154 | AGCGGGTCAUCGAAGACAGACUC | 455 | 1132-1154 |
| AD-1534633 | GUCUUCGAUGACCCGCGUCGU | 192 | 1138-1158 | ACGACGCGGGUCAUCGAAGACAG | 456 | 1136-1158 |
| AD-1534634 | GUGCAAGGGUCCUGAUGCCCU | 193 | 523-543 | AGGGCATCAGGACCCUUGCACUG | 457 | 521-543 |
| AD-1534635 | GUGGUGACCGCAACAAGCCAU | 194 | 1806-1826 | AUGGCUGUUGCGGUCACCACAG | 458 | 1804-1826 |
| AD-1534636 | GUUGCGCCUUCAGGAGGAUGU | 195 | 1429-1449 | ACAUCCUCCUGAAGGCGCAACAG | 459 | 1427-1449 |
| AD-1534637 | GUUGCGCCUUCAGGAGGAUGU | 196 | 1429-1449 | ACAUCCUCCUGAAGGCGCAACAG | 460 | 1427-1449 |
| AD-1534638 | UAAGUACAAAGCUGAAGAGCU | 197 | 124-144 | AGCUCUUCAGCUUGUACUUAUG | 461 | 122-144 |
| AD-1534639 | UAAGUACAAAGCUGAAGAGCU | 198 | 124-144 | AGCUCUUCAGCUUUGUACUUAUG | 462 | 122-144 |
| AD-1534640 | UACAUCGCCGCGCUGUACUGU | 199 | 1193-1213 | ACAGTACAGCGCGGCGAUGUAGG | 463 | 1191-1213 |
| AD-1534641 | UACCUGGCCUGGAUCCGGGAU | 200 | 1850-1870 | ATCCCGGAUCCAGGCCAGGUAGU | 464 | 1848-1870 |
| AD-1534642 | UACUACCUGGCCUGGAUCCGU | 201 | 1847-1867 | ACGGAUCCAGGCCAGGUAGUAGG | 465 | 1845-1867 |
| AD-1534643 | UCAACACUUUCGAUUCCACCU | 202 | 83-103 | AGGUGGAAUCGAAAGUGUUGACU | 466 | 81-103 |
| AD-1534644 | UCACCCUGCAAGGCAUCAUCU | 203 | 1770-1790 | AGAUGAUGCCUUGCAGGGUGAGC | 467 | 1768-1790 |
| AD-1534645 | UCAGCCGGUGUGCCUGCCAAU | 204 | 1483-1503 | AUUGGCAGGCACACCGGCUGAAC | 468 | 1481-1503 |
| AD-1534646 | UCAGGAGGAUGCGGACGGCAU | 205 | 1438-1458 | AUGCCGUCCGCAUCCUCCUGAAG | 469 | 1436-1458 |
| AD-1534647 | UCAGGGACUCAUCUUUCCCUU | 206 | 1890-1910 | AAGGGAAAGAUGAGUCCCUGAGC | 470 | 1888-1910 |
| AD-1534648 | UCCGCAAGAGUCUGUCUUCGU | 207 | 1125-1145 | ACGAAGACAGACUCUUGCGGAGC | 471 | 1123-1145 |
| AD-1534649 | UCCUGUCGCCUUACGUUCAGU | 208 | 1467-1487 | ACUGAACGUAAGGCGACAGGAGC | 472 | 1465-1487 |
| AD-1534650 | UCGCCUUACGUUCAGCCGGUU | 209 | 1472-1492 | AACCGGCUGAACGUAAGGCGACA | 473 | 1470-1492 |
| AD-1534651 | UCUCUGUCCACAACACCUCAU | 210 | 394-414 | AUGAGGTGUUGUGGACAGAGACA | 474 | 392-414 |
| AD-1534652 | UCUGUUGCGCCUUCAGGAGGU | 211 | 1426-1446 | ACCUCCUGAAGGCGCAACAGAGC | 475 | 1424-1446 |
| AD-1534653 | UGAAGAGCACACAGUCGUUCU | 212 | 136-156 | AGAACGACUGUGUGCUCUUCAGC | 476 | 134-156 |
| AD-1534654 | UGAGCCUCAGCUUCUCCGGUU | 213 | 445-465 | AACCGGAGAAGCUGAGGCUCAAA | 477 | 443-465 |
| AD-1534655 | UGAGCUGGGAGUACUGCGACU | 214 | 891-911 | AGUCGCAGUACUCCCAGCUCAGC | 478 | 889-911 |
| AD-1534656 | UGAUGGCCGCGGGCUCAGCUU | 215 | 691-711 | AAGCUGAGCCCGCGGCCAUCAUA | 479 | 689-711 |
| AD-1534657 | UGCAAGGCAUCAUCAGCUGGU | 216 | 1776-1796 | ACCAGCTGAUGAUGCCUUGCAGG | 480 | 1774-1796 |
| AD-1534658 | UGCAAGGCAUCAUCAGCUGGU | 217 | 1776-1796 | ACCAGCTGAUGAUGCCUUGCAGG | 481 | 1774-1796 |
| AD-1534659 | UGCAAGGGUCCUGAUGCCCAU | 218 | 524-544 | AUGGGCAUCAGGACCCUUGCACU | 482 | 522-544 |
| AD-1534660 | UGCCAGUGCAAGGGUCCUGAU | 219 | 518-538 | AUCAGGACCCUUGCACUGGCAUC | 483 | 516-538 |
| AD-1534661 | UGCCAUGAGGGCUCUGCUGCU | 220 | 34-54 | AGCAGCAGAGCCCUCAUGGCAUC | 484 | 32-54 |
| AD-1534662 | UGCGCCUUCAGGAGGAUGCGU | 221 | 1431-1451 | ACGCAUCCUCCTGAAGGCGCAAC | 485 | 1429-1451 |
| AD-1534663 | UGCUCAGGGACUCAUCUUUCU | 222 | 1887-1907 | AGAAAGAUGAGUCCCUGAGCAAU | 486 | 1885-1907 |
| AD-1534664 | UGCUCAGGGACUCAUCUUUCU | 223 | 1887-1907 | AGAAAGAUGAGUCCCUGAGCAAU | 487 | 1885-1907 |
| AD-1534665 | UGGAGUCAACACUUUCGAUUU | 224 | 78-98 | AAAUCGAAAGUGUUGACUCCAAG | 488 | 76-98 |
| AD-1534666 | UGGCCAGAUGCCAGUGCAAGU | 225 | 510-530 | ACUUGCACUGGCAUCUGGCCACA | 489 | 508-530 |

TABLE 2-continued

Unmodified Sense and Antisense Strand Sequences of F12 dsRNA Agents

| Duplex Name | Sense Strand Sequence 5' to 3' | SEQ ID NO: | Range in NM_000505.4 | Antisense Strand Sequence 5' to 3' | SEQ ID NO: | Range in NM_000505.4 |
|---|---|---|---|---|---|---|
| AD-1534667 | UGGCCUACUACCUGGCCUGGU | 226 | 1842-1862 | ACCAGGCCAGGUAGUAGGCCACA | 490 | 1840-1862 |
| AD-1534668 | UGGCUCUGUUGCGCCUUCAGU | 227 | 1422-1442 | ACUGAAGGCGCAACAGAGCCAGG | 491 | 1420-1442 |
| AD-1534669 | UGGUGACCGCAACAAGCCAGU | 228 | 1807-1827 | ACUGGCUGUUGCGGUCACCACA | 492 | 1805-1827 |
| AD-1534670 | UGUACCACAAAUGUACCCACU | 229 | 207-227 | AGUGGGUACAUUUGUGGUACAGC | 493 | 205-227 |
| AD-1534671 | UGUCUCUGUCCACAACACCUU | 230 | 392-412 | AAGGUGUUGUGGACAGAGACAGU | 494 | 390-412 |
| AD-1534672 | UGUGGCCAGAUGCCAGUGCAU | 231 | 508-528 | AUGCACTGGCAUCUGGCCACAGC | 495 | 506-528 |
| AD-1534673 | UUACGUUCAGCCGGUGUGCCU | 232 | 1477-1497 | AGGCACACCGGCUGAACGUAAGG | 496 | 1475-1497 |
| AD-1534674 | UUCAUGUCCCACUCAUGCCCU | 233 | 969-989 | AGGGCAUGAGUGGGACAUGAAGC | 497 | 967-989 |
| AD-1534675 | UUCGAUGACCCGCGUCGUUGU | 234 | 1141-1161 | ACAACGACGCGGGUCAUCGAAGA | 498 | 1139-1161 |
| AD-1534676 | UUGAGCCUCAGCUUCUCCGGU | 235 | 444-464 | ACCGGAGAAGCUGAGGCUCAAAG | 499 | 442-464 |
| AD-1534677 | UUGGAGCCCAAGAAAGUGAAU | 236 | 302-322 | AUUCACUUUCUUGGGCUCCAAAC | 500 | 300-322 |
| AD-1534678 | UUGGAGUCAACACUUUCGAUU | 237 | 77-97 | AAUCGAAAGUGUUGACUCCAAGC | 501 | 75-97 |
| AD-1534679 | UUUGAGCCUCAGCUUCUCCGU | 238 | 443-463 | ACGGAGAAGCUGAGGCUCAAAGC | 502 | 441-463 |
| AD-1631272 | AAGAGCACACAGUCGUUCUCU | 239 | 138-158 | AGAGAACGACUGUGUGCUCUUCU | 503 | 136-158 |
| AD-1631273 | AAUAAAGUGCUUUGAAAAUGU | 240 | 2013-2033 | ACAUUUCAAAGCACUUUAUUCU | 504 | 2011-2033 |
| AD-1631274 | ACAUCGCCGCGCUGUACUGGU | 241 | 1194-1214 | ACCAGUACAGCGCGGCGAUGUCU | 505 | 1192-1214 |
| AD-1631275 | ACCAGCACGACCUGGCUCUGU | 242 | 1410-1430 | ACAGAGCCAGGUCGUGCUGGUCU | 506 | 1408-1430 |
| AD-1631276 | ACCCUGCAAGGCAUCAUCAGU | 243 | 1772-1792 | ACUGAUGAUGCCUUGCAGGGUCU | 507 | 1770-1792 |
| AD-1631277 | ACCGCAACAAGCCAGGCGUCU | 244 | 1812-1832 | AGACGCCUGGCUUGUUGCGGUCU | 508 | 1810-1832 |
| AD-1631278 | ACUACCUGGCCUGGAUCCGGU | 245 | 1848-1868 | ACCGGAUCCAGGCCAGGUAGUCU | 509 | 1846-1868 |
| AD-1631279 | AUUGCUCAGGGACUCAUCUUU | 246 | 1885-1905 | AAAGAUGAGUCCCUGAGCAAUCU | 510 | 1883-1905 |
| AD-1631280 | CAGGGACUCAUCUUUCCCUCU | 247 | 1891-1911 | AGAGGGAAAGAUGAGUCCCUGCU | 511 | 1889-1911 |
| AD-1631281 | CCACAAAUGUACCCACAAGGU | 248 | 211-231 | ACCUUGUGGGUACAUUUGUGGCU | 512 | 209-231 |
| AD-1631282 | CCGCAAGAGUCUGUCUUCGAU | 249 | 1126-1146 | AUCGAAGACAGACUCUUGCGGCU | 513 | 1124-1146 |
| AD-1631283 | CCGGAACCCGGACAACGACAU | 250 | 835-855 | AUGUCGUUGUCCGGGUUCCGGCU | 514 | 833-855 |
| AD-1631284 | CCUGUCGCCUUACGUUCAGCU | 251 | 1468-1488 | AGCUGAACGUAAGGCGACAGGCU | 515 | 1466-1488 |
| AD-1631285 | CGCCUUACGUUCAGCCGGUGU | 252 | 1473-1493 | ACACCGGCUGAACGUAAGGCGCU | 516 | 1471-1493 |
| AD-1631286 | CGUGCCAGGGUGAUUCCGGAU | 253 | 1710-1730 | AUCCGGAAUCACCCUGGCACGCU | 517 | 1708-1730 |
| AD-1631287 | CUACCUGGCCUGGAUCCGGGU | 254 | 1849-1869 | ACCCGGAUCCAGGCCAGGUAGCU | 518 | 1847-1869 |
| AD-1631288 | CUCAGGGACUCAUCUUUCCCU | 255 | 1889-1909 | AGGGAAAGAUGAGUCCCUGAGCU | 519 | 1887-1909 |
| AD-1631289 | CUUCGAUGACCCGCGUCGUUU | 256 | 1140-1160 | AAACGACGCGGGUCAUCGAAGCU | 520 | 1138-1160 |
| AD-1631290 | GAAGAGCACACAGUCGUUCUU | 257 | 137-157 | AAGAACGACGUGUGCUCUUCCU | 521 | 135-157 |
| AD-1631291 | GAGCCUCAGCUUCUCCGGUUU | 258 | 446-466 | AAACCGGAGAAGCUGAGGCUCCU | 522 | 444-466 |
| AD-1631292 | GCCAGAUGCCAGUGCAAGGGU | 259 | 512-532 | ACCCUUGCACUGGCAUCUGGCCU | 523 | 510-532 |
| AD-1631293 | GCCUUACGUUCAGCCGGUGUU | 260 | 1474-1494 | AACACCGGCUGAACGUAAGGCCU | 524 | 1472-1494 |
| AD-1631294 | GCGCAGGAACUCAAUAAAGUU | 261 | 2001-2021 | AACUUAUUGAGUUCCUGCGCCU | 525 | 1999-2021 |
| AD-1631295 | GCGCCUUCAGGAGGAUGCGGU | 262 | 1432-1452 | ACCGCAUCCUCCUGAAGGCGCCU | 526 | 1430-1452 |

TABLE 2-continued

Unmodified Sense and Antisense Strand Sequences of F12 dsRNA Agents

| Duplex Name | Sense Strand Sequence 5' to 3' | SEQ ID NO: | Range in NM_000505.4 | Antisense Strand Sequence 5' to 3' | SEQ ID NO: | Range in NM_000505.4 |
|---|---|---|---|---|---|---|
| AD-1631296 | GCUCAGGGACUCAUCUUUCCU | 263 | 1888-1908 | AGGAAAGAUGAGUCCCUGAGCCU | 527 | 1886-1908 |
| AD-1631297 | GCUCUGCGCAGGGUUCCUCGU | 264 | 1675-1695 | ACGAGGAACCCTGCGCAGAGCCU | 528 | 1673-1695 |
| AD-1631298 | GCUCUGUUGCGCCUUCAGGAU | 265 | 1424-1444 | ATCCTGAAGGCGCAACAGAGCCU | 529 | 1422-1444 |
| AD-1631299 | GCUUUGAGCCUCAGCUUCUCU | 266 | 441-461 | AGAGAAGCUGAGGCUCAAAGCCU | 530 | 439-461 |
| AD-1631300 | GGAGUCAACACUUUCGAUUCU | 267 | 79-99 | AGAATCGAAAGTGUUGACUCCCU | 531 | 77-99 |
| AD-1631301 | GGCUCUGUUGCGCCUUCAGGU | 268 | 1423-1443 | ACCUGAAGGCGCAACAGAGCCCU | 532 | 1421-1443 |
| AD-1631302 | GUCGCCUUACGUUCAGCCGGU | 269 | 1471-1491 | ACCGGCTGAACGUAAGGCGACCU | 533 | 1469-1491 |
| AD-1631303 | GUCUUCGAUGACCCGCGUCGU | 270 | 1138-1158 | ACGACGCGGGUCAUCGAAGACCU | 534 | 1136-1158 |
| AD-1631304 | GUUGCGCCUUCAGGAGGAUGU | 271 | 1429-1449 | ACAUCCUCCUGAAGGCGCAACCU | 535 | 1427-1449 |
| AD-1631305 | UCGCCUUACGUUCAGCCGGUU | 272 | 1472-1492 | AACCGGCUGAACGUAAGGCGACU | 536 | 1470-1492 |
| AD-1631306 | UGAGCCUCAGCUUCUCCGGUU | 273 | 445-465 | AACCGGAGAAGCUGAGGCUCACU | 537 | 443-465 |
| AD-1631307 | UGCGCCUUCAGGAGGAUGCGU | 274 | 1431-1451 | ACGCAUCCUCCTGAAGGCGCACU | 538 | 1429-1451 |
| AD-1631308 | UGCUCAGGGACUCAUCUUUCU | 275 | 1887-1907 | AGAAAGAUGAGUCCCUGAGCACU | 539 | 1885-1907 |
| AD-1631309 | UGGAGUCAACACUUUCGAUUU | 276 | 78-98 | AAAUCGAAAGUGUUGACUCCACU | 540 | 76-98 |
| AD-1631310 | UGGCCUACUACCUGGCCUGGU | 277 | 1842-1862 | ACCAGGCCAGGUAGUAGGCCACU | 541 | 1840-1862 |
| AD-1631311 | UUCGAUGACCCGCGUCGUUGU | 278 | 1141-1161 | ACAACGACGCGGGUCAUCGAACU | 542 | 1139-1161 |
| AD-1631312 | UUGAGCCUCAGCUUCUCCGGU | 279 | 444-464 | ACCGGAGAAGCUGAGGCUCAACU | 543 | 442-464 |
| AD-85525 | ACUCAAUAAAGUGCUUUGAAA | 280 | 2009-2029 | UUUCAAAGCACUUUAUUGAGUUC | 544 | 2007-2029 |
| AD-85531 | UCAAUAAAGUGCUUUGAAAAU | 281 | 2011-2031 | AUUUUCAAAGCACUUUAUUGAGU | 545 | 2009-2031 |
| AD-85537 | CUCAAUAAAGUGCUUUGAAAA | 282 | 2010-2030 | UUUCAAAGCACUUUAUUGAGUU | 546 | 2008-2030 |
| AD-85541 | GAACUCAAUAAAGUGCUUUGA | 283 | 2007-2027 | UCAAAGCACUUUAUUGAGUUCCU | 547 | 2005-2027 |
| AD-67246 | AAUAAAGUGCUUUGAAAACGU | 284 | 2013-2030 | ACGUUUCAAAGCACUUUAUUGA | 548 | 2011-2030 |

TABLE 3

Modified Sense and Antisense Strand Sequences of F12 dsRNA Agents

| Duplex Name | Sense Strand Sequence 5' to 3' | SEQ ID NO: | Antisense Strand Sequence 5' to 3' | SEQ ID NO: |
|---|---|---|---|---|
| AD-1534462 | asasagagaaGfUfGfcuuugagccuL96 | 549 | asGfsgcdTc(Agn)aagcacUfuCfucuuuscsu | 813 |
| AD-1534463 | asasauguacCfCfAfcaagggccguL96 | 550 | asdCsggdCcdCuugudGgGfuacauuusgsu | 814 |
| AD-1534464 | asascccggaCfAfAfcgacauccguL96 | 551 | asdCsggdAudGucgudTgUfccggguuscsc | 815 |
| AD-1534465 | asascucaauAfAfAfgugcuuugauL96 | 552 | asdTscadAadGcacudTuAfuugaguuscsc | 816 |
| AD-1534466 | asascugagcAfAfGfcagcugugguL96 | 553 | asdCscadCadGcugcdTuGfcucaguuscsu | 817 |
| AD-1534467 | asasgaaugaGfAfUfauggguauaguL96 | 554 | asdCsuadTadCcauadTcUfcauucuusgsu | 818 |
| AD-1534468 | asasgagcacAfCfAfgucguucucuL96 | 555 | asdGsagdAadCgacudGuGfugcucuuscsa | 819 |
| AD-1534469 | asasgcagcuGfUfGfgccagaugcuL96 | 556 | asGfscadTc(Tgn)ggccacAfgCfugcuusgsc | 820 |
| AD-1534470 | asasgcugcuAfUfGfauggccgcguL96 | 557 | asdCsgcdGgdCcaucdAuAfgcagcuusgsc | 821 |
| AD-1534471 | asasguacaaAfGfCfugaagagcauL96 | 558 | asUfsgcdTc(Tgn)ucagcuUfuGfuacuusasu | 822 |

TABLE 3-continued

Modified Sense and Antisense Strand Sequences of F12 dsRNA Agents

| | | | | | |
|---|---|---|---|---|---|
| AD-1534472 | asasgugcuuUfGfAfgccucagcuuL96 | 559 | asAfsgcdTg(Agn)ggcucaAfaGfcacuuscsu | 823 |
| AD-1534473 | asasuaaaguGfCfUfuugaaaaauguL96 | 560 | asdCsaudTudTcaaadGcAfcuuuauusgsa | 824 |
| AD-1534474 | ascsaaauguAfCfCfcacaagggcuL96 | 561 | asdGsccdCudTguggdGuAfcauuugusgsg | 825 |
| AD-1534475 | ascsacaqucGfUfUfcucacugucuL96 | 562 | asGfsacdAg(Tgn)gagaacGfaCfugugusgsc | 826 |
| AD-1534476 | ascsaccgauGfUfGfgccuacuacuL96 | 563 | asGfsuadGu(Agn)ggccacAfuCfggugusasg | 827 |
| AD-1534477 | ascsacuuucGfAfUfuccaccuuguL96 | 564 | asdCsaadGgdTggaadTcGfaaagugususg | 828 |
| AD-1534478 | ascsacuuucGfAfUfuccaccuuguL96 | 565 | asCfsaadGg(Tgn)ggaaucGfaAfagugususg | 829 |
| AD-1534479 | ascsagucguUfCfUfcacugucacuL96 | 566 | asGfsugdAc(Agn)gugagaAfcGfacugusgsu | 830 |
| AD-1534480 | ascsaucgccGfCfGfcguacugguL96 | 567 | asdCscadGudAcagcdGcGfgcgaugusasg | 831 |
| AD-1534481 | ascscagcacGfAfCfcuggcucuguL96 | 568 | asdCsagdAgdCcaggdTcGfugcuggusasg | 832 |
| AD-1534482 | ascsccggacAfAfCfgacauccgcuL96 | 569 | asGfscgdGa(Tgn)gucguuGfuCfcgggususc | 833 |
| AD-1534483 | ascsccugcaAfGfGfcaucaucaguL96 | 570 | asdCsugdAudGaugcdCuUfgcagggusgsa | 834 |
| AD-1534484 | ascscgcaacAfAfGfccaggcgucuL96 | 571 | asdGsacdGcdCuggcdTuGfuugcgguscsa | 835 |
| AD-1534485 | ascscuggcuCfUfGfuugcgccuuuL96 | 572 | asdAsagdGcdGcaacdAgAfgccaggusCsg | 836 |
| AD-1534486 | ascsguucagCfFfCfGfgugugccuguL96 | 573 | asCfsagdGc(Agn)caccggCfuGfaacgusasa | 837 |
| AD-1534487 | ascsuaccugGfCfCfcuggauccgguL96 | 574 | asdCscgdGadTccagdGcCfagguagusasg | 838 |
| AD-1534488 | ascsucaauaAfAfGfugcuuugaauL96 | 575 | asdTsucdAadAgcacdTuUfauugagususc | 839 |
| AD-1534489 | ascsugagcaAfGfCfagcugugggcuL96 | 576 | asGfsccdAc(Agn)gcugcuUfgCfucagusuc | 840 |
| AD-1534490 | asgsagaaguGfCfUfuugagccucuL96 | 577 | asGfsagdGc(Tgn)caaagcAfcUfucucususu | 841 |
| AD-1534491 | asgsagcacaCfAfGfucguucauL96 | 578 | asUfsgadGa(Agn)cgacugUfgUfgcucususc | 842 |
| AD-1534492 | asgsagucugUfCfUfucgaugaccuL96 | 579 | asGfsgudCa(Tgn)cgaagaCfaGfacucususg | 843 |
| AD-1534493 | asgsaugccaGfUfGfcaagggccuL96 | 580 | asdGsgadCcdCuugcdAcUfggcaucusgsg | 844 |
| AD-1534494 | asgscacgacCfUfGfgcucuguuguL96 | 581 | asdCsaadCadGagccdAgGfucgugcusgsg | 845 |
| AD-1534495 | asgsccaggcGfUfCfuacaccgauuL96 | 582 | asdAsucdGgdTguagdAcGfccuggcususg | 846 |
| AD-1534496 | asgsccaggcGfUfCfuacaccgauuL96 | 583 | asAfsucdGg(Tgn)guagacGfcCfuggcususg | 847 |
| AD-1534497 | asgscccaagAfAfAfgugaaagacuL96 | 584 | asGfsucdTu(Tgn)cacuuuCfuUfgggcuscsc | 848 |
| AD-1534498 | asgscugaagAfGfCfacacagucguL96 | 585 | asdCsgadCudGugugdCuCfuucagcusuusu | 849 |
| AD-1534499 | asgscugcuaUfGfAfuggccgcgguL96 | 586 | asdCscgdCgdGccaudCaUfagcagcususg | 850 |
| AD-1534500 | asgscuguacCfAfCfcaaaauguaccuL96 | 587 | asGfsgudAc(Agn)uuugugGfuAfcagcusgsc | 851 |
| AD-1534501 | asgsgagcauAfAfGfuacaaagcuuL96 | 588 | asdAsgcdTudTguacdTuAfugcucsusg | 852 |
| AD-1534502 | asgsgagcauAfAfGfuacaaagcuuL96 | 589 | asAfsgcdTu(Tgn)guacuuAfuGfcuccususg | 853 |
| AD-1534503 | asgsgauggcGfCfAfggaacucaauL96 | 590 | asUfsugdAg(Tgn)uccugcGfcCfauccusgsg | 854 |
| AD-1534504 | asgsgcgucuAfCfAffccgaugugguL96 | 591 | asdCscadCadTcggudGuAfgacgccsgsg | 855 |
| AD-1534505 | asgsgcuucaUfGfUfucccacucauuL96 | 592 | asAfsugdAg(Tgn)gggacaUfgAfagccusasg | 856 |
| AD-1534506 | asgsucaacaCfUfUfufcgauuccauL96 | 593 | asdTsggdAadTcgaadAgUfguugacuscsc | 857 |
| AD-1534507 | asgsucaacaCfUfUfufcgauuccauL96 | 594 | asUfsggdAa(Tgn)cgaaagUfgUfugacuscsc | 858 |
| AD-1534508 | asusaaagugCfUfUfugaaaaugcuL96 | 595 | asdGscadTudTcaaadAgCfacuuuausus | 859 |
| AD-1534509 | asusccgcccGfUfGfgugcuucguuL96 | 596 | asdAscgdAadGcaccdAcGfggcggausgsu | 860 |
| AD-1534510 | asuscgggcuGfUfGfgugaccgcauL96 | 597 | asUfsgcdGg(Tgn)caccacAfgCfccgauscsc | 861 |

TABLE 3-continued

Modified Sense and Antisense Strand Sequences of F12 dsRNA Agents

| | | | | | |
|---|---|---|---|---|---|
| AD-1534511 | asusgccaguGfCfAfagggguccuguL96 | 598 | asdCsagdGadCccuudGcAfcuggcauscsu | 862 |
| AD-1534512 | asusgcucugCfGfCfagggguuccuuL96 | 599 | asdAsggdAadCccugdCgCfagagcausgsc | 863 |
| AD-1534513 | asusguacccAfCfAfagggccggcuL96 | 600 | asdGsccdGgdCccuudGuGfgguacaususu | 864 |
| AD-1534514 | asusugcucaGfGfGfacucaucuuuL96 | 601 | asdAsagdAudGagucdCcUfgagcaauscsa | 865 |
| AD-1534515 | csasaagcugAfAfGfagcacacaguL96 | 602 | asCfsugdTg(Tgn)gcucuuCfaGfcuuugsusa | 866 |
| AD-1534516 | csasaauguaCfCfCfacaagggccuL96 | 603 | asGfsgcdCc(Tgn)uguggUfaCfauuugsusg | 867 |
| AD-1534517 | csasagaaagUfGfAfaagaccacuuL96 | 604 | asAfsgudGg(Tgn)cuuucaCfuUfucuugsgsg | 868 |
| AD-1534518 | csasagagucUfGfUfcuucgauganL96 | 605 | asdTscadTcdGaagadCaGfacucuugscsg | 869 |
| AD-1534519 | csasaggagcAfUfAfaguacaaaguL96 | 606 | asCfsuudTg(Tgn)acuuauGfcUfccuugsgsg | 870 |
| AD-1534520 | csascaaauuGfAfCfccacaagguL96 | 607 | asdCsccdTudGugggdTaCfauuugugsgsu | 871 |
| AD-1534521 | csascccugcAfAfGfgcaucaucauL96 | 608 | asUfsgadTg(Agn)ugccuuGfcAfgggugsasg | 872 |
| AD-1534522 | csasccgaugUfGfGfccuacuaccuL96 | 609 | asGfsgudAg(Tgn)aggccaCfaUfcggugsusa | 873 |
| AD-1534523 | csasgccuGfCfCfucuguugcguL96 | 610 | asdCsgcdAadCagagdCcAfggucgugscsu | 874 |
| AD-1534524 | csascugucuCfUfGfuccacaacauL96 | 611 | asUfsgudTg(Tgn)ggacagAfgAfcagugsgsg | 875 |
| AD-1534525 | csascuuucgAfUfUfccaccuugguL96 | 612 | asdCscadAgdGuggadAuCfgaaagugsusu | 876 |
| AD-1534526 | csasgaugccAfGfUfgcaaggqgucuL96 | 613 | asGfsacdCc(Tgn)ugcacuGfgCfaucugsgsc | 877 |
| AD-1534527 | csasgcacgaCfCfUfggcucuguuuL96 | 614 | asAfsacdAg(Agn)gccaggUfcGfugcugsgsu | 878 |
| AD-1534528 | csasgcuguaCfCfAfcaaauguacuL96 | 615 | asdGsuadCadTuugudGgUfacagcugscsc | 879 |
| AD-1534529 | csasgcugugGfCfCfagaugcccaguL96 | 616 | asCfsugdGc(Agn)ucuggcCfaCfagcugscsu | 880 |
| AD-1534530 | csasggaacuCfAfAfuaaagugcuuL96 | 617 | asAfsgcdAc(Tgn)uuauugAfgUfuccugscsg | 881 |
| AD-1534531 | csasggauggCfGfCfaggaacucaL96 | 618 | asUfsgadGu(Tgn)ccugcgCfcAfuccugsgsc | 882 |
| AD-1534532 | csasggcgucUfAfCfaccgauguuL96 | 619 | asdCsacdAudCggugdTaGfacgccugsgsc | 883 |
| AD-1534533 | csasgggacuCfAfUfcuuuccccuL96 | 620 | asdGsagdGgdAaagadTgAfgucccugsasg | 884 |
| AD-1534534 | csasgugcaaGfGfGfuccugaugcuL96 | 621 | asGfscadTc(Agn)ggaccccUfuGfcacugsgsc | 885 |
| AD-1534535 | cscsacaaauGfUfAfcccacaagguL96 | 622 | asdCscudTgdTgggudAcAfuuugugsgsusa | 886 |
| AD-1534536 | cscsacaaauGfUfAfcccacaagguL96 | 623 | asCfscudTg(Tgn)ggguacAfuUfuguggsusa | 887 |
| AD-1534537 | cscsagaugcCfAfGfugcaagggguuL96 | 624 | asdAsccdCudTgcacdTgGfcaucuggscsc | 888 |
| AD-1534538 | cscsaggcguCfUfAfcaccgauguuL96 | 625 | asdAscadTcdGgugudAgAfcgccuggscsu | 889 |
| AD-1534539 | cscscaagaaAfGfUfgaaagaccauL96 | 626 | asUfsggdTc(Tgn)uucacuUfuCfuugggscsu | 890 |
| AD-1534540 | cscscggacaAfCfGfacauccgccuL96 | 627 | asdGsgcdGgdAugucdGuUfguccgggsusu | 891 |
| AD-1534541 | cscscggacaAfCfGfacauccgccuL96 | 628 | asGfsgcdGg(Agn)ugucguUfgUfccgggsusu | 892 |
| AD-1534542 | cscscugcaaGfGfCfaucaucagcuL96 | 629 | asGfscudGa(Tgn)gaugccUfuGfcagggsusg | 893 |
| AD-1534543 | cscsgaugugGfCfCfuacuaccuguL96 | 630 | asdCsagdGudAguagdGcCfacaucggsusg | 894 |
| AD-1534544 | cscsgcaacaAfCfCfcaggcgucuuL96 | 631 | asdAsgadCgdCcuggdCuUfguugcggsusc | 895 |
| AD-1534545 | cscsgcaagaGfUfCfugucuucgauL96 | 632 | asdTscgdAadGacagdAcUfcuugcggsasg | 896 |
| AD-1534546 | cscsggaaccCfGfGfacaacgacauL96 | 633 | asdTsgudCgdTugucdCgGfguuccggscsa | 897 |
| AD-1534547 | cscsggaaccCfGfGfacaacgacauL96 | 634 | asUfsgudCg(Tgn)uguccgGfgUfuccggscsa | 898 |
| AD-1534548 | cscsugcaggAfGfGfcgcagguacuL96 | 635 | asGfsuadCc(Tgn)gcgccuCfcUfgcaggsasa | 899 |
| AD-1534549 | cscsugucgcCfUfUfacguucagcuL96 | 636 | asdGscudGadAcguadAgGfcgacaggsasg | 900 |

TABLE 3-continued

Modified Sense and Antisense Strand Sequences of F12 dsRNA Agents

| | | | | | |
|---|---|---|---|---|---|
| AD-1534550 | cscsugucgcCfUfUfacguucagcuL96 | 637 | asGfscudGa(Agn)cguaagGfcGfacaggsasg | 901 |
| AD-1534551 | cscsuuacguUfCfAfgccgguguguL96 | 638 | asdCsacdAcdCggcudGaAfcguaaggscsg | 902 |
| AD-1534552 | csgscaacaaGfCfCfaggcgucuauL96 | 639 | asdTsagdAcdGccugdGcUfuguugcgsgsu | 903 |
| AD-1534553 | csgscaggaaCfUfCfaauaaagguguL96 | 640 | asdCsacdTudTauugdAgUfccugcgscsc | 904 |
| AD-1534554 | csgsccuuacGfUfUfcagccgguguL96 | 641 | asdCsacdCgdGcugadAcGfuaaggcgsasc | 905 |
| AD-1534555 | csgscuccugUfCfGfccuuacguuuL96 | 642 | asdAsacdGudAaggcdGaCfaggagcgscsg | 906 |
| AD-1534556 | csgsgaacccGfGfAfcaacgacauuL96 | 643 | asdAsugdTcdGuugudCcGfgguuccgsgsc | 907 |
| AD-1534557 | csgsgcuccgCfAfAfgagucugucuL96 | 644 | asGfsacdAg(Agn)cucuugCfgGfagccgscsu | 908 |
| AD-1534558 | csgsucuacaCfCfGfaugugggccuuL96 | 645 | asAfsggdCc(Agn)caucggUfgUfagacgscsc | 909 |
| AD-1534559 | csgsugccagGfUfUfgauuccggauL96 | 646 | asdTsccdGgdAaucadCcCfuggcacgscsa | 910 |
| AD-1534560 | csusacaucgCfCfGfcgcuguacuuL96 | 647 | asAfsgudAc(Agn)gcgcggCfgAfuguagsgsg | 911 |
| AD-1534561 | csusaccuggCfUfUfgggauccggguL96 | 648 | asdCsccdGgdAuccadGgCfcagguagsusa | 912 |
| AD-1534562 | csuscaauaaAfGfUfgcuuugaaauL96 | 649 | asdTsuudCadAagcadCuUfuauugagsusu | 913 |
| AD-1534563 | csuscaauaaAfGfUfgcuuugaaauL96 | 650 | asUfsuudCa(Agn)agcacuUfuAfuugagsusu | 914 |
| AD-1534564 | csuscagggaCfUfCffaucuuucccuL96 | 651 | asdGsggdAadAgaugdAgUfcccugagscsa | 915 |
| AD-1534565 | csusccugucGfCfCfuuacguucauL96 | 652 | asdTsgadAcdGuaagdGcGfacaggagscsg | 916 |
| AD-1534566 | csuscuguugCfGfCfcuucaggaguL96 | 653 | asdCsucdCudGaaggdCgCfaacagagscsc | 917 |
| AD-1534567 | csusgaagagCfAfCfacagucguuuL96 | 654 | asdAsacdGadCugugdTgCfucuucagscsu | 918 |
| AD-1534568 | csusgauugcUfCfAfgggacucauuL96 | 655 | asAfsugdAg(Tgn)cccugaGfcAfaucagsgsa | 919 |
| AD-1534569 | csusgcaaggCfAfUfcaucagcuguL96 | 656 | asdCsagdCudGaugadTgCfcuugcagsgsg | 920 |
| AD-1534570 | csusgccggaAfCfCfcggacaacguL96 | 657 | asCfsgudTg(Tgn)ccgguUfcCfggcagsasa | 921 |
| AD-1534571 | csusguaccaCfAfAfauguacccauL96 | 658 | asUfsggdGu(Agn)cauuugUfgGfuacagscsu | 922 |
| AD-1534572 | csusgucgccUfUfAfcguucagccuL96 | 659 | asGfsgcdTg(Agn)acguaaGfcCfgacagsgsa | 923 |
| AD-1534573 | csusgucucuGfUfCfcacaacaccuL96 | 660 | asGfsgudGu(Tgn)guggacAfgAfgacagsusg | 924 |
| AD-1534574 | csusguggugAfCfCfgcaacaagcuL96 | 661 | asGfscudTg(Tgn)ugcgguCfaCfcacagscsc | 925 |
| AD-1534575 | csusuacguuCfAfGfccggugugcuL96 | 662 | asdGscadCadCcggcdTgAfacguaagsgsc | 926 |
| AD-1534576 | csusucgaugAfCfCfcgcgucguuuL96 | 663 | asdAsacdGadCgcggdGuCfaucgaagsasc | 927 |
| AD-1534577 | csusuggaguCfAfAfcacuuucgauL96 | 664 | asdTscgdAadAgugudTgAfcuccaagscsu | 928 |
| AD-1534578 | csusuuugagcCfUfCfagcuucccuL96 | 665 | asGfsgadGa(Agn)gcugagGfcUfcaaagscsa | 929 |
| AD-1534579 | gsasaagugaAfAfGfaccacugcauL96 | 666 | asUfsgcdAg(Tgn)ggucuuUfcAfcuuucsusu | 930 |
| AD-1534580 | gsasacccggAfCfAfacgacauccuL96 | 667 | asGfsgadTg(Tgn)cguugucCfcGfgguuscsg | 931 |
| AD-1534581 | gsasacucaaUfAfAfagugcuuuguL96 | 668 | asdCsaadAgdCacuudTaUfugaguucscsu | 932 |
| AD-1534582 | gsasagagcaCfAfCfagucguucuuL96 | 669 | asdAsgadAcdGacugdTgUfgcucuucsasg | 933 |
| AD-1534583 | gsasccgcaaCfAfAfgccaggcguuL96 | 670 | asAfscgdCc(Tgn)ggcuugUfuGfcggucsasc | 934 |
| AD-1534584 | gsasgcacacAfGfUfcguucucacuL96 | 671 | asdGsugdAgdAacgadCuGfugugcucsusu | 935 |
| AD-1534585 | gsasgcauaaGfUfAfcaaagcugauL96 | 672 | asUfscadGc(Tgn)uuguacUfuAfugcucscsu | 936 |
| AD-1534586 | gsasgccucaGfCfUfucucccgguuL96 | 673 | asdAsacdCgdGagaadGcUfgaggcucsasa | 937 |
| AD-1534587 | gsasgucuguCfUfUfcgaugacccuL96 | 674 | asGfsggdTc(Agn)ucgaagAfcAfgacucsusu | 938 |
| AD-1534588 | gsasugccagUfGfCfaagggguccuuL96 | 675 | asdAsggdAcdCcugdCaCfuggcaucsusg | 939 |

TABLE 3-continued

Modified Sense and Antisense Strand Sequences of F12 dsRNA Agents

| | | | | |
|---|---|---|---|---|
| AD-1534589 | gsasuggcgcAfGfGfaacucaauauL96 | 676 | asUfsaudTg(Agn)guuccuGfcGfccaucscsu | 940 |
| AD-1534590 | gsasuugcucAfGfGfgacucaucucuL96 | 677 | asAfsgadTg(Agn)gucccuGfaGfcaaucsasg | 941 |
| AD-1534591 | gscsaagagucCfUfGfucuucgauguL96 | 678 | asdCsaudCgdAagacdAgAfcucuugcsgsg | 942 |
| AD-1534592 | gscsacacagUfCfGfuucucacuguL96 | 679 | asCfsagdTg(Agn)gaacgaCfuGfugugcsusc | 943 |
| AD-1534593 | gscsacgaccUfGfGfcucuguugcuL96 | 680 | asdGscadAcdAgagcdCaGfgucgugcsusg | 944 |
| AD-1534594 | gscsacgaccUfGfGfcucuguugcuL96 | 681 | asGfscadAc(Agn)gagccaGfgUfcgugcsusg | 945 |
| AD-1534595 | gscsagcuguGfGfCfcagaugccauL96 | 682 | asUfsgggdCa(Tgn)cuggccAfcAfgcugcsusu | 946 |
| AD-1534596 | gscsaggaacUfCfAfauaaaagugcuL96 | 683 | asdGscadCudTuauudGaGfuuccugcsgsc | 947 |
| AD-1534597 | gscscagaugCfCfAfgugcaaggguL96 | 684 | asdCsccdTudGcacudGgCfaucuggcscsa | 948 |
| AD-1534598 | gscscaggcgUfCfUfacaccgauguL96 | 685 | asdCsaudCgdGuguadGaCfgccuggcsusu | 949 |
| AD-1534599 | gscsccaagaAfAfGfugaaagaccuL96 | 686 | asGfsgudCu(Tgn)ucacuuUfcUfugggcsusc | 950 |
| AD-1534600 | gscscuuacgUfUfCfagccgguguuL96 | 687 | asdAscadCcdGgcugdAaCfguaaggcsgsa | 951 |
| AD-1534601 | gscsgcaggaAfCfUfcaauaaaguuL96 | 688 | asdAscudTudAuugadGuUfccugcgcscsa | 952 |
| AD-1534602 | gscsgccuucAfGfGfaggaugcgguL96 | 689 | asdCscgdCadTccucdCuGfaaggcgcsasa | 953 |
| AD-1534603 | gscsggcuccGfCfAfagagucguuL96 | 690 | asdAscadGadCucuudGcGfgagccgcsusg | 954 |
| AD-1534604 | gscsucagggAfCfUfcaucuuuccuL96 | 691 | asdGsgadAadGaugadGuCfccugagcsasa | 955 |
| AD-1534605 | gscsuccgcaAfGfAfgucugucuuuL96 | 692 | asAfsagdAc(Agn)gacucuUfgCfggagcscsg | 956 |
| AD-1534606 | gscsuccuguCfGfCfcuuacguucuL96 | 693 | asdGsaadCgdTaaggdCgAfcaggagcsgsc | 957 |
| AD-1534607 | gscsucugcgCfAfGfgguuccucguL96 | 694 | asdCsgadGgdAaccedTgCfgcagagcsasu | 958 |
| AD-1534608 | gscsucugcgCfAfGfgguuccucguL96 | 695 | asCfsgadGg(Agn)acccugCfgCfagagcsasu | 959 |
| AD-1534609 | gscsucuguuGfCfGfccuucaggauL96 | 696 | asdTsccdTgdAaggcdGcAfacagagcscsa | 960 |
| AD-1534610 | gscsucuguuGfCfGfccuucaggauL96 | 697 | asUfsccdTg(Agn)aggcgcAfaCfagagcscsa | 961 |
| AD-1534611 | gscsugaagaGfCfAfcacagucguuL96 | 698 | asdAscgdAcdTgugudGcUfcuucagcsusu | 962 |
| AD-1534612 | gscsugcuauGfAfUfggccgcgguuL96 | 699 | asdCsccdGcdGgccadTcAfuagcagcsusu | 963 |
| AD-1534613 | gscsugguguGfUfGfaggaccaaguL96 | 700 | asCfsuudGg(Tgn)ccucacAfcAfccagcsgsg | 964 |
| AD-1534614 | gscsuguggUfGfAfCfcgcaacaaguL96 | 701 | asdCsuudGudTgcggdTcAfccacagcscsc | 965 |
| AD-1534615 | gscsuguggUfGfAfCfcgcaacaaguL96 | 702 | asCfsuudGu(Tgn)gcggucAfcCfacagcscsc | 966 |
| AD-1534616 | gscsuucaugUfCfCfcacucaugcuL96 | 703 | asGfscadTg(Agn)guggaCfaUfgaagcscsu | 967 |
| AD-1534617 | gscsuuugagCfCfUfcagcuuccucuL96 | 704 | asdGsagdAadGcugadGgCfucaaagcsasc | 968 |
| AD-1534618 | gsgsaacucaAfUfAfaagugcuuuuL96 | 705 | asAfsaadGc(Agn)cuuuauUfgAfguuccsusg | 969 |
| AD-1534619 | gsgsagcauaAfGfUfacaaagcuguL96 | 706 | asdCsagdCudTuguadCuUfaugcuccsusu | 970 |
| AD-1534620 | gsgsagcccaAfAfGfAfaagugaaaguL96 | 707 | asCfsuudTc(Agn)cuuucuUfgGfcuccsasa | 971 |
| AD-1534621 | gsgsagucaaCfAfCffuuucgauucuL96 | 708 | asdGsaadTcdGaaagdTgUfugacuccsasa | 972 |
| AD-1534622 | gsgscgucuaCfAfCfcgauguggcuL96 | 709 | asdGsccdAcdAucggdTgUfagacgccsusg | 973 |
| AD-1534623 | gsgscgucuaCfAfCfcgauguggcuL96 | 710 | asGfsccdAc(Agn)ucggugUfaGfacgccsusg | 974 |
| AD-1534624 | gsgscuccgcAfAfGfagucugucuuuL96 | 711 | asdAsgadCadGacucdTuGfcggagccsgsc | 975 |
| AD-1534625 | gsgscucuguUfGfCfCfgccuucaggauL96 | 712 | asdCscudGadAggcgdCaAfcagagccsasg | 976 |
| AD-1534626 | gsgsguccugAfUfGfcccacugccuL96 | 713 | asGfsgcdAg(Tgn)gggcauCfaGfgacccsusu | 977 |
| AD-1534627 | gsuscaacacUfUfUfcgauuccacuL96 | 714 | asdGsugdGadAucgadAaGfuguugacsusc | 978 |

TABLE 3-continued

Modified Sense and Antisense Strand Sequences of F12 dsRNA Agents

| | | | | |
|---|---|---|---|---|
| AD-1534628 | gsuscaacacUfUfUfcgauuccacuL96 | 715 | asGfsugdGa(Agn)ucgaaaGfuGfuugacsusc | 979 |
| AD-1534629 | gsuscgccuuAfCfGfuucagccgguL96 | 716 | asdCscgdGcdTgaacdGuAfaggcgacsasg | 980 |
| AD-1534630 | gsuscgccuuAfCfGfuucagccgguL96 | 717 | asCfscgdGc(Tgn)gaacguAfaGfgcgacsasg | 981 |
| AD-1534631 | gsuscguucuCfAfCfugucaccgguL96 | 718 | asdCscgdGudGacagdTgAfgaacgacsusg | 982 |
| AD-1534632 | gsuscugucuUfCfGfaugacccgcuL96 | 719 | asGfscgdGg(Tgn)caucgaAfgAfcagacsusc | 983 |
| AD-1534633 | gsuscuucgaUfGfAfcccgcgucguL96 | 720 | asdCsgadCgdCgggudCaUfcgaagacsasg | 984 |
| AD-1534634 | gsusgcaaggGfUfCfcugaugcccuL96 | 721 | asGfsgggdCa(Tgn)caggacCfcUfugcacsusg | 985 |
| AD-1534635 | gsusggugacCfGfCfaacaagccauL96 | 722 | asUfsgggdCu(Tgn)guugcgGfuCfaccacsasg | 986 |
| AD-1534636 | gsusugcgccUfUfCfaggaggauguL96 | 723 | asdCsaudCcdTccugdAaGfgcgcaacsasg | 987 |
| AD-1534637 | gsusugcgccUfUfCfaggaggauguL96 | 724 | asCfsaudCc(Tgn)ccugaaGfgCfgcaacsasg | 988 |
| AD-1534638 | usasaguacaAfAfGfcugaagagcuL96 | 725 | asdGscudCudTcagcdTuUfguacuuasusg | 989 |
| AD-1534639 | usasaguacaAfAfGfcugaagagcuL96 | 726 | asGfscudCu(Tgn)cagcuuUfgUfacuuasusg | 990 |
| AD-1534640 | usascaucgcCfGfCfgcuguacuguL96 | 727 | asdCsagdTadCagcgdCgGfcgauguasgsg | 991 |
| AD-1534641 | usasccuggcCfUfGfgauccgggauL96 | 728 | asdTsccdCgdGauccdAgGfccagguasgsu | 992 |
| AD-1534642 | usascuaccuGfCfGfcuggauccguL96 | 729 | asdCsggdAudCcaggdCcAfgguaguasgsg | 993 |
| AD-1534643 | uscsaacacuUfUfCfgauuccaccuL96 | 730 | asGfsgudGg(Agn)aucgaaAfgUfguugascsu | 994 |
| AD-1534644 | uscsaccccugCfAfAfggcaucaucuL96 | 731 | asGfsaudGa(Tgn)gccuugCfaGfggugasgsc | 995 |
| AD-1534645 | uscsagccggUfGfUfgccugccaauL96 | 732 | asUfsugdGc(Agn)ggcacaCfcGfgcugasasc | 996 |
| AD-1534646 | uscsaggaggAfUfGfcggacggcauL96 | 733 | asUfsgcdCg(Tgn)ccgcauCfcUfccugasasg | 997 |
| AD-1534647 | uscsagggacUfCfAfucuuucccuuL96 | 734 | asdAsggdGadAagaudGaGfucccugasgsc | 998 |
| AD-1534648 | uscscgcaagAfGfUfucugucuucguL96 | 735 | asdCsgadAgdAcagadCuCfuugcggasgsc | 999 |
| AD-1534649 | uscscugucgCfCfUfuacguucaguL96 | 736 | asdCsugdAadCguaadGgCfgacaggasgsc | 1000 |
| AD-1534650 | uscsgccuuaCfGfUfucagccgguL96 | 737 | asdAsccdGgdCugaadCgUfaaggcgascsa | 1001 |
| AD-1534651 | uscsucugucCfAfCfaacaccucauL96 | 738 | asUfsgadGg(Tgn)guugugGfaCfagagascsa | 1002 |
| AD-1534652 | uscsuguugcGfCfCfuucaggagguL96 | 739 | asdCscudCcdTgaagdGcGfcaacagasgsc | 1003 |
| AD-1534653 | usgsaagagcAfCfAfcagucguucuL96 | 740 | asdGsaadCgdAcugudGuGfcucuucasgsc | 1004 |
| AD-1534654 | usgsagccucAfGfCfuucucccgguL96 | 741 | asdAsccdGgdAgaagdCuGfaggcucasasa | 1005 |
| AD-1534655 | usgsagcuggGfAfGfuacugcgacuL96 | 742 | asGfsucdGc(Agn)guacucCfcAfgcucasgsc | 1006 |
| AD-1534656 | usgsauggccGfCfGfgggcucagcuuL96 | 743 | asAfsgcdTg(Agn)gcccgcGfgCfcaucasusa | 1007 |
| AD-1534657 | usgscaaggcAfUfCfaucagcugguL96 | 744 | asdCscadGcdTgaugdAuGfccuugcasgsg | 1008 |
| AD-1534658 | usgscaaggcAfUfCfaucagcugguL96 | 745 | asCfscadGc(Tgn)gaugauGfcCfuugcasgsg | 1009 |
| AD-1534659 | usgscaagggUfCfCfugaugcccauL96 | 746 | asUfsgggdGc(Agn)ucaggaCfcCfuugcascsu | 1010 |
| AD-1534660 | usgsccagugCfAfAfgggccugauL96 | 747 | asUfscadGg(Agn)cccuugCfaCfuggcascsu | 1011 |
| AD-1534661 | usgsccaugaGfGfGfcucugcugcuL96 | 748 | asGfscadGc(Agn)gagcccUfcAfuggcascsc | 1012 |
| AD-1534662 | usgscgccuuCfAfGfgaggaucguL96 | 749 | asdCsgcdAudCcuccdTgAfaggcgcasasc | 1013 |
| AD-1534663 | usgscucaggGfAfCfucaucuuucuL96 | 750 | asdGsaadAgdAugagdTcCfcugagcasasu | 1014 |
| AD-1534664 | usgscucaggGfAfCfucaucuuucuL96 | 751 | asGfsaadAg(Agn)ugagucCfcUfgagcasasu | 1015 |
| AD-1534665 | usgsgagucaAfCfAfcuuucgauuuL96 | 752 | asdAsaudCgdAaagudGuUfgacuccasasg | 1016 |
| AD-1534666 | usgsgccagaUfGfCfcagugcaaguL96 | 753 | asCfsuudGc(Agn)cuggcaUfcUfggccascsa | 1017 |

TABLE 3-continued

Modified Sense and Antisense Strand Sequences of F12 dsRNA Agents

| | | | | |
|---|---|---|---|---|
| AD-1534667 | usgsgccuacUfAfCfcuggccugguL96 | 754 | asdCscadGgdCcaggdTaGfuaggccascsa | 1018 |
| AD-1534668 | usgsgcucugUfUfGfcgccuucaguL96 | 755 | asdCsugdAadGgcgcdAaCfagagccasgsg | 1019 |
| AD-1534669 | usgsgugaccGfCfAfacaagccaguL96 | 756 | asCfsugdGc(Tgn)uguugcGfgUfcaccascsa | 1020 |
| AD-1534670 | usgsuaccacAfAfAfuguacccacuL96 | 757 | asGfsugdGg(Tgn)acauuuGfuGfguacasgsc | 1021 |
| AD-1534671 | usgsucucugUfCfCfacaacaccuuL96 | 758 | asAfsggdTg(Tgn)uguggaCfaGfagacasgsu | 1022 |
| AD-1534672 | usgsuggccaGfAfUfgccagugcauL96 | 759 | asUfsgcdAc(Tgn)ggcaucUfgGfccacasgsc | 1023 |
| AD-1534673 | ususacguucAfGfCfcggugugccuL96 | 760 | asGfsgcdAc(Agn)ccggcuGfaAfcguaasgsg | 1024 |
| AD-1534674 | ususcaugucCfCfAfcucaugcccuL96 | 761 | asGfsggdCa(Tgn)gaguggGfaCfaugaasgsc | 1025 |
| AD-1534675 | ususcgaugaCfCfCfgcgucguuguL96 | 762 | asdCsaadCgdAcgcgdGgUfcaucgaasgsa | 1026 |
| AD-1534676 | ussgagccuCfAfGfcuuccucgguL96 | 763 | asdCscgdGadGaagcdTgAfggcucaasasg | 1027 |
| AD-1534677 | ususgggagccCfAfAfgaaagugaauL96 | 764 | asUfsucdAc(Tgn)uucuugGfgCfuccaasasc | 1028 |
| AD-1534678 | ususggagucAfAfCfacuuucgauuL96 | 765 | asdAsucdGadAagugdTuGfacuccaasgsc | 1029 |
| AD-1534679 | ususugagccUfCfAfgcuuccucguL96 | 766 | asdCsggdAgdAagcudGaGfcucaaasgsc | 1030 |
| AD-1631272 | asasgagcacAfCfAfgucguucucuL96 | 767 | asdGsagdAadCgacudGuUfgcucuuscsu | 1031 |
| AD-1631273 | asasuaaaguGfCfUfuugaaaauguL96 | 768 | asdCsaudTudTcaaadGcAfcuuuauuscsu | 1032 |
| AD-1631274 | ascsaucgccGfCfGfcuguacugguL96 | 769 | asdCscadGudAcagcdGcGfgcgauguscsu | 1033 |
| AD-1631275 | ascscagcacGfAfCfcuggcucuguL96 | 770 | asdCsagdAgdCcaggdTcGfugcggguscsu | 1034 |
| AD-1631276 | ascsccugcaAfGfGfcaucaucaguL96 | 771 | asdCsugdAudGaugcdCuUfgcagguscsu | 1035 |
| AD-1631277 | ascsccgcaacAfAfGfccaggcgucuL96 | 772 | asdGsacdGcdCuggcdTuGfuugcgguscsu | 1036 |
| AD-1631278 | ascsuaccugGfCfCfcuggauccguL96 | 773 | asdCscgdGadTccagdGcCfagguaguscsu | 1037 |
| AD-1631279 | asusugcucaGfGfGfacucaucuuuL96 | 774 | asdAsagdAudGagucdCcUfgagcaauscsu | 1038 |
| AD-1631280 | csasgggacuCfAfUfcuuucccucuL96 | 775 | asdGsagdGgdAaagadTgAfgucccugscsu | 1039 |
| AD-1631281 | cscsacaaauGfUfAfcccacaagguL96 | 776 | asdCscudTgdTgggudAcAfuuugugggscsu | 1040 |
| AD-1631282 | cscsgcaagaGfUfCfugucuucgauL96 | 777 | asdTscgdAadGacagdAcUfcuugcggscsu | 1041 |
| AD-1631283 | cscsggaaccCfGfGfacaacgacauL96 | 778 | asdTsgudCgdTugucdCgGfguuccggscsu | 1042 |
| AD-1631284 | cscsugucgcCfUfUfacguucagcuL96 | 779 | asdGscudGadAcguadAgGfcgacaggscsu | 1043 |
| AD-1631285 | csgsccuuacGfUfUfcagccggugucL96 | 780 | asdCsacdCgdGcugadAcGfuaaggcgscsu | 1044 |
| AD-1631286 | csgsugccagGfGfUfgauuccggauL96 | 781 | asdTsccdGgdAaucadCcCfuggcacgscsu | 1045 |
| AD-1631287 | csusaccuggCfCfUfgggauccgguL96 | 782 | asdCsccdGgdAuccadGgCfcagguagscsu | 1046 |
| AD-1631288 | csuscagggaCfUfCfaucuuuccccuL96 | 783 | asdGsggdAadAgaugdAgUfcccugagscsu | 1047 |
| AD-1631289 | csusucgaugAfCfCfcgcgucguuuL96 | 784 | asdAsacdGadCgcggdGuCfaucgaagscsu | 1048 |
| AD-1631290 | gsasagagcaCfAfCfagucguucuuL96 | 785 | asdAsgadAcdGacugdTgUfgcucuucscsu | 1049 |
| AD-1631291 | gsasgccucaGfCfUfucuccgguuuL96 | 786 | asdAsacdCgdGagaadGcUfgaggcucscsu | 1050 |
| AD-1631292 | gscscagaugCfCfAfgugcaaggguL96 | 787 | asdCsccdTudGcacudGgCfaucuggcscsu | 1051 |
| AD-1631293 | gscscuuacgUfUfCfagccgguguuL96 | 788 | asdAscadCcdGgcugdAaCfguaaggcscsu | 1052 |
| AD-1631294 | gscsgcaggaAfCfUfcaauaaaguuL96 | 789 | asdAscudTudAuugadGuUfccgcgcscsu | 1053 |
| AD-1631295 | gscsgccuucAfGfGfaggaugcgguL96 | 790 | asdCscgdCadTccucdCuGfaaggcgcscsu | 1054 |
| AD-1631296 | gscsucagggAfCfUfUfcaucuuuccuL96 | 791 | asdGsgadAadGaugadGuCfccugagcscsu | 1055 |
| AD-1631297 | gscsucugcgCfAfGfgguuccucguL96 | 792 | asdCsgadGgdAacccdTgCfgcagagcscsu | 1056 |

TABLE 3-continued

Modified Sense and Antisense Strand Sequences of F12 dsRNA Agents

| AD-1631298 | gscsucuguuGfCfGfccuucaggauL96 | 793 | asdTsccdTgdAaggcdGcAfacagagcscsu | 1057 |
| --- | --- | --- | --- | --- |
| AD-1631299 | gscsuuugagCfCfUfcagcuucucuL96 | 794 | asdGsagdAadGcugadGgCfucaaagcscsu | 1058 |
| AD-1631300 | gsgsagucaaCfAfCfuuucgauucuL96 | 795 | asdGsaadTcdGaaagdTgUfugacuccscsu | 1059 |
| AD-1631301 | gsgscucuguUfGfCfgccuucagguL96 | 796 | asdCscudGadAggcgdCaAfcagagccscsu | 1060 |
| AD-1631302 | gsuscgccuuAfCfGfuucagccgguL96 | 797 | asdCscgdGcdTgaacdGuAfaggcgacscsu | 1061 |
| AD-1631303 | gsuscuucgaUfGfAfcccgcgucguL96 | 798 | asdCsgadCgdCgggudCaUfcgaagacscsu | 1062 |
| AD-1631304 | gsusugcgccUfUfCfaggaggauguL96 | 799 | asdCsaudCcdTccugdAaGfgcgcaacscsu | 1063 |
| AD-1631305 | uscsgccuuaCfGfUfuucagccgguL96 | 800 | asdAsccdGgdCugaadCgUfaaggcgascsu | 1064 |
| AD-1631306 | usgsagccucAfGfCfuucuccgguuL96 | 801 | asdAsccdGgdAgaagdCuGfaggcucascsu | 1065 |
| AD-1631307 | usgscgccuuCfAfGfgaggaugcguL96 | 802 | asdCsgcdAudCcuccdTgAfaggcgcascsu | 1066 |
| AD-1631308 | usgscucaggGfAfCfucaucuuucuL96 | 803 | asdGsaadAgdAugagdTcCfcugagcascsu | 1067 |
| AD-1631309 | usgsgagucaAfCfAfcuuucgauuuL96 | 804 | asdAsaudCgdAaagudGuUfgacuccascsu | 1068 |
| AD-1631310 | usgsgccuacUfAfCfcuggccgguL96 | 805 | asdCscadGgdCcaggdTaGfuaggccascsu | 1069 |
| AD-1631311 | ususcgaugaCfCfCfgcgucguuguL96 | 806 | asdCsaadCgdAcgcgdGgUfcaucgaascsu | 1070 |
| AD-1631312 | ususgagccuCfAfGfcuucuccgguL96 | 807 | asdCscgdGadGaagcdTgAfggcucaascsu | 1071 |
| AD-85525 | ascsucaaUfaAfAfGfugcuuugaaaL96 | 808 | usUfsucaaagcacuuUfaUfugagususc | 1072 |
| AD-85531 | uscsaauaAfaAfGfUfGfcuuugaaaauL96 | 809 | asUfsuuucaaagcacUfuUfauugasgsu | 1073 |
| AD-85537 | csuscaauAfaAfGfUfgcuuugaaaaL96 | 810 | usFfsuucaaagcacuUfuAfuugagsusu | 1074 |
| AD-85541 | gsasacucAfaUfAfAfagugcuuugaL96 | 811 | usCfsaaaagcacuuuaUfuGfaguucscsu | 1075 |
| AD-67246 | asasuaaaGfuGfCfUfuugaaaacguL96 | 812 | asCfsguuUfuCfAfaagcAfcUfuuauusgsa | 1076 |

| Duplex Name | mRNA target sequence 5' to 3' | SEQ ID NO: |
| --- | --- | --- |
| AD-1534462 | AGAAAGAGAAGUGCUUUGAGCCU | 1077 |
| AD-1534463 | ACAAAUGUACCCACAAGGGCCGG | 1078 |
| AD-1534464 | GGAACCCGGACAACGACAUCCGC | 1079 |
| AD-1534465 | GGAACUCAAUAAAGUGCUUUGAA | 1080 |
| AD-1534466 | AGAACUGAGCAAGCAGCUGUGGC | 1081 |
| AD-1534467 | ACAAGAAUGAGAUAUGGUAUAGA | 1082 |
| AD-1534468 | UGAAGAGCACACAGUCGUUCUCA | 1083 |
| AD-1534469 | GCAAGCAGCUGUGGCCAGAUGCC | 1084 |
| AD-1534470 | GCAAGCUGCUAUGAUGGCCGCGG | 1085 |
| AD-1534471 | AUAAGUACAAAGCUGAAGAGCAC | 1086 |
| AD-1534472 | AGAAGUGCUUUGAGCCUCAGCUU | 1087 |
| AD-1534473 | UCAAUAAAGUGCUUUGAAAAUGC | 1088 |
| AD-1534474 | CCACAAAUGUACCCACAAGGGCC | 1089 |
| AD-1534475 | GCACACAGUCGUUCUCACUGUCA | 1090 |
| AD-1534476 | CUACACCGAUGUGGCCUACUACC | 1091 |
| AD-1534477 | CAACACUUUCGAUUCCACCUUGG | 1092 |
| AD-1534478 | CAACACUUUCGAUUCCACCUUGG | 1093 |

TABLE 3-continued

Modified Sense and Antisense Strand Sequences of F12 dsRNA Agents

| | | |
|---|---|---|
| AD-1534479 | ACACAGUCGUUCUCACUGUCACC | 1094 |
| AD-1534480 | CUACAUCGCCGCGCUGUACUGGG | 1095 |
| AD-1534481 | CUACCAGCACGACCUGGCUCUGU | 1096 |
| AD-1534482 | GAACCCGGACAACGACAUCCGCC | 1097 |
| AD-1534483 | UCACCCUGCAAGGCAUCAUCAGC | 1098 |
| AD-1534484 | UGACCGCAACAAGCCAGGCGUCU | 1099 |
| AD-1534485 | CGACCUGGCUCUGUUGCGCCUUC | 1100 |
| AD-1534486 | UUACGUUCAGCCGGUGUGCCUGC | 1101 |
| AD-1534487 | CUACUACCUGGCCUGGAUCCGGG | 1102 |
| AD-1534488 | GAACUCAAUAAAGUGCUUUGAAA | 1103 |
| AD-1534489 | GAACUGAGCAAGCAGCUGUGGCC | 1104 |
| AD-1534490 | AAAGAGAAGUGCUUUGAGCCUCA | 1105 |
| AD-1534491 | GAAGAGCACACAGUCGUUCUCAC | 1106 |
| AD-1534492 | CAAGAGUCUGUCUUCGAUGACCC | 1107 |
| AD-1534493 | CCAGAUGCCAGUGCAAGGGUCCU | 1108 |
| AD-1534494 | CCAGCACGACCUGGCUCUGUUGC | 1109 |
| AD-1534495 | CAAGCCAGGCGUCUACACCGAUG | 1110 |
| AD-1534496 | CAAGCCAGGCGUCUACACCGAUG | 1111 |
| AD-1534497 | GGAGCCCAAGAAAGUGAAAGACC | 1112 |
| AD-1534498 | AAAGCUGAAGAGCACACAGUCGU | 1113 |
| AD-1534499 | CAAGCUGCUAUGAUGGCCGCGGG | 1114 |
| AD-1534500 | GCAGCUGUACCACAAAUGUACCC | 1115 |
| AD-1534501 | CAAGGAGCAUAAGUACAAAGCUG | 1116 |
| AD-1534502 | CAAGGAGCAUAAGUACAAAGCUG | 1117 |
| AD-1534503 | CCAGGAUGGCGCAGGAACUCAAU | 1118 |
| AD-1534504 | CCAGGCGUCUACACCGAUGUGGC | 1119 |
| AD-1534505 | CUAGGCUUCAUGUCCCACUCAUG | 1120 |
| AD-1534506 | GGAGUCAACACUUUCGAUUCCAC | 1121 |
| AD-1534507 | GGAGUCAACACUUUCGAUUCCAC | 1122 |
| AD-1534508 | CAAUAAAGUGCUUUGAAAAUGCU | 1123 |
| AD-1534509 | ACAUCCGCCCGUGGUGCUUCGUG | 1124 |
| AD-1534510 | GGAUCGGGCUGUGGUGACCGCAA | 1125 |
| AD-1534511 | AGAUGCCAGUGCAAGGGUCCUGA | 1126 |
| AD-1534512 | GCAUGCUCUGCGCAGGGUUCCUC | 1127 |
| AD-1534513 | AAAUGUACCCACAAGGGCCGGCC | 1128 |
| AD-1534514 | UGAUUGCUCAGGGACUCAUCUUU | 1129 |
| AD-1534515 | UACAAAGCUGAAGAGCACACAGU | 1130 |
| AD-1534516 | CACAAAUGUACCCACAAGGGCCG | 1131 |
| AD-1534517 | CCCAAGAAAGUGAAAGACCACUG | 1132 |

TABLE 3-continued

Modified Sense and Antisense Strand Sequences of F12 dsRNA Agents

| | | |
|---|---|---|
| AD-1534518 | CGCAAGAGUCUGUCUUCGAUGAC | 1133 |
| AD-1534519 | CCCAAGGAGCAUAAGUACAAAGC | 1134 |
| AD-1534520 | ACCACAAAUGUACCCACAAGGGC | 1135 |
| AD-1534521 | CUCACCCUGCAAGGCAUCAUCAG | 1136 |
| AD-1534522 | UACACCGAUGUGGCCUACUACCU | 1137 |
| AD-1534523 | AGCACGACCUGGCUCUGUUGCGC | 1138 |
| AD-1534524 | CCCACUGUCUCUGUCCACAACAC | 1139 |
| AD-1534525 | AACACUUUCGAUUCCACCUUGGG | 1140 |
| AD-1534526 | GCCAGAUGCCAGUGCAAGGGUCC | 1141 |
| AD-1534527 | ACCAGCACGACCUGGCUCUGUUG | 1142 |
| AD-1534528 | GGCAGCUGUACCACAAAUGUACC | 1143 |
| AD-1534529 | AGCAGCUGUGGCCAGAUGCCAGU | 1144 |
| AD-1534530 | CGCAGGAACUCAAUAAAGUGCUU | 1145 |
| AD-1534531 | GCCAGGAUGGCGCAGGAACUCAA | 1146 |
| AD-1534532 | GCCAGGCGUCUACACCGAUGUGG | 1147 |
| AD-1534533 | CUCAGGGACUCAUCUUUCCCUCC | 1148 |
| AD-1534534 | GCCAGUGCAAGGGUCCUGAUGCC | 1149 |
| AD-1534535 | UACCACAAAUGUACCCACAAGGG | 1150 |
| AD-1534536 | UACCACAAAUGUACCCACAAGGG | 1151 |
| AD-1534537 | GGCCAGAUGCCAGUGCAAGGGUC | 1152 |
| AD-1534538 | AGCAGGCGUCUACACCGAUGUG | 1153 |
| AD-1534539 | AGCCCAAGAAAGUGAAAGACCAC | 1154 |
| AD-1534540 | AACCCGGACAACGACAUCCGCCC | 1155 |
| AD-1534541 | AACCCGGACAACGACAUCCGCCC | 1156 |
| AD-1534542 | CACCCUGCAAGGCAUCAUCAGCU | 1157 |
| AD-1534543 | CACCGAUGUGGCCUACUACCUGG | 1158 |
| AD-1534544 | GACCGCAACAAGCCAGGCGUCUA | 1159 |
| AD-1534545 | CUCCGCAAGAGUCUGUCUUCGAU | 1160 |
| AD-1534546 | UGCCGGAACCCGGACAACGACAU | 1161 |
| AD-1534547 | UGCCGGAACCCGGACAACGACAU | 1162 |
| AD-1534548 | UUCCUGCAGGAGGCGCAGGUACC | 1163 |
| AD-1534549 | CUCCUGUCGCCUUACGUUCAGCC | 1164 |
| AD-1534550 | CUCCUGUCGCCUUACGUUCAGCC | 1165 |
| AD-1534551 | CGCCUUACGUUCAGCCGGUGUGC | 1166 |
| AD-1534552 | ACCGCAACAAGCCAGGCGUCUAC | 1167 |
| AD-1534553 | GGCGCAGGAACUCAAUAAAGUGC | 1168 |
| AD-1534554 | GUCGCCUUACGUUCAGCCGGUGU | 1169 |
| AD-1534555 | CGCGCUCCUGUCGCCUUACGUUC | 1170 |
| AD-1534556 | GCCGGAACCCGGACAACGACAUC | 1171 |

TABLE 3-continued

Modified Sense and Antisense Strand Sequences of F12 dsRNA Agents

| | | |
|---|---|---|
| AD-1534557 | AGCGGCUCCGCAAGAGUCUGUCU | 1172 |
| AD-1534558 | GGCGUCUACACCGAUGUGGCCUA | 1173 |
| AD-1534559 | UGCGUGCCAGGGUGAUUCCGGAG | 1174 |
| AD-1534560 | CCCUACAUCGCCGCGCUGUACUG | 1175 |
| AD-1534561 | UACUACCUGGCCUGGAUCCGGGA | 1176 |
| AD-1534562 | AACUCAAUAAAGUGCUUUGAAAA | 1177 |
| AD-1534563 | AACUCAAUAAAGUGCUUUGAAAA | 1178 |
| AD-1534564 | UGCUCAGGGACUCAUCUUUCCCU | 1179 |
| AD-1534565 | CGCUCCUGUCGCCUUACGUUCAG | 1180 |
| AD-1534566 | GGCUCUGUUGCGCCUUCAGGAGG | 1181 |
| AD-1534567 | AGCUGAAGAGCACACAGUCGUUC | 1182 |
| AD-1534568 | UCCUGAUUGCUCAGGGACUCAUC | 1183 |
| AD-1534569 | CCCUGCAAGGCAUCAUCAGCUGG | 1184 |
| AD-1534570 | UUCUGCCGGAACCCGGACAACGA | 1185 |
| AD-1534571 | AGCUGUACCACAAAUGUACCCAC | 1186 |
| AD-1534572 | UCCUGUCGCCUUACGUUCAGCCG | 1187 |
| AD-1534573 | CACUGUCUCUGUCCACAACACCU | 1188 |
| AD-1534574 | GGCUGUGGUGACCGCAACAAGCC | 1189 |
| AD-1534575 | GCCUUACGUUCAGCCGGUGUGCC | 1190 |
| AD-1534576 | GUCUUCGAUGACCCGCGUCGUUG | 1191 |
| AD-1534577 | AGCUUGGAGUCAACACUUUCGAU | 1192 |
| AD-1534578 | UGCUUUGAGCCUCAGCUUCUCCG | 1193 |
| AD-1534579 | AAGAAAGUGAAAGACCACUGCAG | 1194 |
| AD-1534580 | CGGAACCCGGACAACGACAUCCG | 1195 |
| AD-1534581 | AGGAACUCAAUAAAGUGCUUUGA | 1196 |
| AD-1534582 | CUGAAGAGCACACAGUCGUUCUC | 1197 |
| AD-1534583 | GUGACCGCAACAAGCCAGGCGUC | 1198 |
| AD-1534584 | AAGAGCACACAGUCGUUCUCACU | 1199 |
| AD-1534585 | AGGAGCAUAAGUACAAAGCUGAA | 1200 |
| AD-1534586 | UUGAGCCUCAGCUUCUCCGGUUU | 1201 |
| AD-1534587 | AAGAGUCUGUCUUCGAUGACCCG | 1202 |
| AD-1534588 | CAGAUGCCAGUGCAAGGGUCCUG | 1203 |
| AD-1534589 | AGGAUGGCGCAGGAACUCAAUAA | 1204 |
| AD-1534590 | CUGAUUGCUCAGGGACUCAUCUU | 1205 |
| AD-1534591 | CCGCAAGAGUCUGUCUUCGAUGA | 1206 |
| AD-1534592 | GAGCACACAGUCGUUCUCACUGU | 1207 |
| AD-1534593 | CAGCACGACCUGGCUCUGUUGCG | 1208 |
| AD-1534594 | CAGCACGACCUGGCUCUGUUGCG | 1209 |
| AD-1534595 | AAGCAGCUGUGGCCAGAUGCCAG | 1210 |

TABLE 3-continued

Modified Sense and Antisense Strand Sequences of F12 dsRNA Agents

| | | |
|---|---|---|
| AD-1534596 | GCGCAGGAACUCAAUAAAGUGCU | 1211 |
| AD-1534597 | UGGCCAGAUGCCAGUGCAAGGGU | 1212 |
| AD-1534598 | AAGCCAGGCGUCUACACCGAUGU | 1213 |
| AD-1534599 | GAGCCCAAGAAAGUGAAAGACCA | 1214 |
| AD-1534600 | UCGCCUUACGUUCAGCCGGUGUG | 1215 |
| AD-1534601 | UGGCGCAGGAACUCAAUAAAGUG | 1216 |
| AD-1534602 | UUGCGCCUUCAGGAGGAUGCGGA | 1217 |
| AD-1534603 | CAGCGGCUCCGCAAGAGUCUGUC | 1218 |
| AD-1534604 | UUGCUCAGGGACUCAUCUUUCCC | 1219 |
| AD-1534605 | CGGCUCCGCAAGAGUCUGUCUUC | 1220 |
| AD-1534606 | GCGCUCCUGUCGCCUUACGUUCA | 1221 |
| AD-1534607 | AUGCUCUGCGCAGGGUUCCUCGA | 1222 |
| AD-1534608 | AUGCUCUGCGCAGGGUUCCUCGA | 1223 |
| AD-1534609 | UGGCUCUGUUGCGCCUUCAGGAG | 1224 |
| AD-1534610 | UGGCUCUGUUGCGCCUUCAGGAG | 1225 |
| AD-1534611 | AAGCUGAAGAGCACACAGUCGUU | 1226 |
| AD-1534612 | AAGCUGCUAUGAUGGCCGCGGGC | 1227 |
| AD-1534613 | CCGCUGGUGUGUGAGGACCAAGC | 1228 |
| AD-1534614 | GGGCUGUGGUGACCGCAACAAGC | 1229 |
| AD-1534615 | GGGCUGUGGUGACCGCAACAAGC | 1230 |
| AD-1534616 | AGGCUUCAUGUCCCACUCAUGCC | 1231 |
| AD-1534617 | GUGCUUUGAGCCUCAGCUUCUCC | 1232 |
| AD-1534618 | CAGGAACUCAAUAAAGUGCUUUG | 1233 |
| AD-1534619 | AAGGAGCAUAAGUACAAAGCUGA | 1234 |
| AD-1534620 | UUGGAGCCCAAGAAAGUGAAAGA | 1235 |
| AD-1534621 | UUGGAGUCAACACUUUCGAUUCC | 1236 |
| AD-1534622 | CAGGCGUCUACACCGAUGUGGCC | 1237 |
| AD-1534623 | CAGGCGUCUACACCGAUGUGGCC | 1238 |
| AD-1534624 | GCGGCUCCGCAAGAGUCUGUCUU | 1239 |
| AD-1534625 | CUGGCUCUGUUGCGCCUUCAGGA | 1240 |
| AD-1534626 | AAGGGUCCUGAUGCCCACUGCCA | 1241 |
| AD-1534627 | GAGUCAACACUUUCGAUUCCACC | 1242 |
| AD-1534628 | GAGUCAACACUUUCGAUUCCACC | 1243 |
| AD-1534629 | CUGUCGCCUUACGUUCAGCCGGU | 1244 |
| AD-1534630 | CUGUCGCCUUACGUUCAGCCGGU | 1245 |
| AD-1534631 | CAGUCGUUCUCACUGUCACCGGG | 1246 |
| AD-1534632 | GAGUCUGUCUUCGAUGACCCGCG | 1247 |
| AD-1534633 | CUGUCUUCGAUGACCCGCGUCGU | 1248 |
| AD-1534634 | CAGUGCAAGGGUCCUGAUGCCCA | 1249 |

TABLE 3-continued

Modified Sense and Antisense Strand Sequences of F12 dsRNA Agents

| | | |
|---|---|---|
| AD-1534635 | CUGUGGUGACCGCAACAAGCCAG | 1250 |
| AD-1534636 | CUGUUGCGCCUUCAGGAGGAUGC | 1251 |
| AD-1534637 | CUGUUGCGCCUUCAGGAGGAUGC | 1252 |
| AD-1534638 | CAUAAGUACAAAGCUGAAGAGCA | 1253 |
| AD-1534639 | CAUAAGUACAAAGCUGAAGAGCA | 1254 |
| AD-1534640 | CCUACAUCGCCGCGCUGUACUGG | 1255 |
| AD-1534641 | ACUACCUGGCCUGGAUCCGGGAG | 1256 |
| AD-1534642 | CCUACUACCUGGCCUGGAUCCGG | 1257 |
| AD-1534643 | AGUCAACACUUUCGAUUCCACCU | 1258 |
| AD-1534644 | GCUCACCCUGCAAGGCAUCAUCA | 1259 |
| AD-1534645 | GUUCAGCCGGUGUGCCUGCCAAG | 1260 |
| AD-1534646 | CUUCAGGAGGAUGCGGACGGCAG | 1261 |
| AD-1534647 | GCUCAGGGACUCAUCUUUCCCUC | 1262 |
| AD-1534648 | GCUCCGCAAGAGUCUGUCUUCGA | 1263 |
| AD-1534649 | GCUCCUGUCGCCUUACGUUCAGC | 1264 |
| AD-1534650 | UGUCGCCUUACGUUCAGCCGGUG | 1265 |
| AD-1534651 | UGUCUCUGUCCACAACACCUCAC | 1266 |
| AD-1534652 | GCUCUGUUGCGCCUUCAGGAGGA | 1267 |
| AD-1534653 | GCUGAAGAGCACACAGUCGUUCU | 1268 |
| AD-1534654 | UUUGAGCCUCAGCUUCUCCGGUU | 1269 |
| AD-1534655 | GCUGAGCUGGGAGUACUGCGACC | 1270 |
| AD-1534656 | UAUGAUGGCCGCGGGCUCAGCUA | 1271 |
| AD-1534657 | CCUGCAAGGCAUCAUCAGCUGGG | 1272 |
| AD-1534658 | CCUGCAAGGCAUCAUCAGCUGGG | 1273 |
| AD-1534659 | AGUGCAAGGGUCCUGAUGCCCAC | 1274 |
| AD-1534660 | GAUGCCAGUGCAAGGGUCCUGAU | 1275 |
| AD-1534661 | GAUGCCAUGAGGGCUCUGCUGCU | 1276 |
| AD-1534662 | GUUGCGCCUUCAGGAGGAUGCGG | 1277 |
| AD-1534663 | AUUGCUCAGGGACUCAUCUUUCC | 1278 |
| AD-1534664 | AUUGCUCAGGGACUCAUCUUUCC | 1279 |
| AD-1534665 | CUUGGAGUCAACACUUUCGAUUC | 1280 |
| AD-1534666 | UGUGGCCAGAUGCCAGUGCAAGG | 1281 |
| AD-1534667 | UGUGGCCUACUACCUGGCCUGGA | 1282 |
| AD-1534668 | CCUGGCUCUGUUGCGCCUUCAGG | 1283 |
| AD-1534669 | UGUGGUGACCGCAACAAGCCAGG | 1284 |
| AD-1534670 | GCUGUACCACAAAUGUACCCACA | 1285 |
| AD-1534671 | ACUGUCUCUGUCCACAACACCUC | 1286 |
| AD-1534672 | GCUGUGGCCAGAUGCCAGUGCAA | 1287 |
| AD-1534673 | CCUUACGUUCAGCCGGUGUGCCU | 1288 |

TABLE 3-continued

Modified Sense and Antisense Strand Sequences of F12 dsRNA Agents

| | | |
|---|---|---|
| AD-1534674 | GCUUCAUGUCCCACUCAUGCCCG | 1289 |
| AD-1534675 | UCUUCGAUGACCCGCGUCGUUGG | 1290 |
| AD-1534676 | CUUUGAGCCUCAGCUUCUCCGGU | 1291 |
| AD-1534677 | GUUUGGAGCCCAAGAAAGUGAAA | 1292 |
| AD-1534678 | GCUUGGAGUCAACACUUUCGAUU | 1293 |
| AD-1534679 | GCUUUGAGCCUCAGCUUCUCCGG | 1294 |
| AD-1631272 | UGAAGAGCACACAGUCGUUCUCA | 1295 |
| AD-1631273 | UCAAUAAAGUGCUUUGAAAAUGC | 1296 |
| AD-1631274 | CUACAUCGCCGCGCUGUACUGGG | 1297 |
| AD-1631275 | CUACCAGCACGACCUGGCUCUGU | 1298 |
| AD-1631276 | UCACCCUGCAAGGCAUCAUCAGC | 1299 |
| AD-1631277 | UGACCGCAACAAGCCAGGCGUCU | 1300 |
| AD-1631278 | CUACUACCUGGCCUGGAUCCGGG | 1301 |
| AD-1631279 | UGAUUGCUCAGGGACUCAUCUUU | 1302 |
| AD-1631280 | CUCAGGGACUCAUCUUUCCCUCC | 1303 |
| AD-1631281 | UACCACAAAUGUACCCACAAGGG | 1304 |
| AD-1631282 | CUCCGCAAGAGUCUGUCUUCGAU | 1305 |
| AD-1631283 | UGCCGGAACCCGGACAACGACAU | 1306 |
| AD-1631284 | CUCCUGUCGCCUUACGUUCAGCC | 1307 |
| AD-1631285 | GUCGCCUUACGUUCAGCCGGUGU | 1308 |
| AD-1631286 | UGCGUGCCAGGGUGAUUCCGGAG | 1309 |
| AD-1631287 | UACUACCUGGCCUGGAUCCGGGA | 1310 |
| AD-1631288 | UGCUCAGGGACUCAUCUUUCCCU | 1311 |
| AD-1631289 | GUCUUCGAUGACCCGCGUCGUUG | 1312 |
| AD-1631290 | CUGAAGAGCACACAGUCGUUCUC | 1313 |
| AD-1631291 | UUGAGCCUCAGCUUCUCCGGUUU | 1314 |
| AD-1631292 | UGGCCAGAUGCCAGUGCAAGGGU | 1315 |
| AD-1631293 | UCGCCUUACGUUCAGCCGGUGUG | 1316 |
| AD-1631294 | UGGCGCAGGAACUCAAUAAAGUG | 1317 |
| AD-1631295 | UUGCGCCUUCAGGAGGAUGCGGA | 1318 |
| AD-1631296 | UUGCUCAGGGACUCAUCUUUCCC | 1319 |
| AD-1631297 | AUGCUCUGCGCAGGGUUCCUCGA | 1320 |
| AD-1631298 | UGGCUCUGUUGCGCCUUCAGGAG | 1321 |
| AD-1631299 | GUGCUUUGAGCCUCAGCUUCUCC | 1322 |
| AD-1631300 | UUGGAGUCAACACUUUCGAUUCC | 1323 |
| AD-1631301 | CUGGCUCUGUUGCGCCUUCAGGA | 1324 |
| AD-1631302 | CUGUCGCCUUACGUUCAGCCGGU | 1325 |
| AD-1631303 | CUGUCUUCGAUGACCCGCGUCGU | 1326 |
| AD-1631304 | CUGUUGCGCCUUCAGGAGGAUGC | 1327 |

TABLE 3-continued

Modified Sense and Antisense Strand Sequences of F12 dsRNA Agents

| | | | |
|---|---|---|---|
| | AD-1631305 | UGUCGCCUUACGUUCAGCCGGUG | 1328 |
| | AD-1631306 | UUUGAGCCUCAGCUUCUCCGGUU | 1329 |
| | AD-1631307 | GUUGCGCCUUCAGGAGGAUGCGG | 1330 |
| | AD-1631308 | AUUGCUCAGGGACUCAUCUUUCC | 1331 |
| | AD-1631309 | CUUGGAGUCAACACUUUCGAUUC | 1332 |
| | AD-1631310 | UGUGGCCUACUACCUGGCCUGGA | 1333 |
| | AD-1631311 | UCUUCGAUGACCCGCGUCGUUGG | 1334 |
| | AD-1631312 | CUUUGAGCCUCAGCUUCUCCGGU | 1335 |
| | AD-85525 | GAACUCAAUAAAGUGCUUUGAAA | 1336 |
| | AD-85531 | ACUCAAUAAAGUGCUUUGAAAAU | 1337 |
| | AD-85537 | AACUCAAUAAAGUGCUUUGAAAA | 1338 |
| | AD-85541 | AGGAACUCAAUAAAGUGCUUUGA | 1339 |
| | AD-67246 | UCAATAAAGTGCTTTGAAAA | 1340 |

TABLE 4

Single Dose Screen in PHH Cells

| Duplex ID | 10 nM | ST DEVP | 1 nM | ST DEVP | 0.1 nM | ST DEVP |
|---|---|---|---|---|---|---|
| AD-1534661.1 | 44.05 | 4.93 | 69.18 | 4.10 | 85.65 | 8.36 |
| AD-1534577.1 | 12.11 | 1.61 | 24.85 | 1.11 | 28.45 | 0.69 |
| AD-1534678.1 | 10.93 | 1.19 | 22.47 | 2.79 | 26.15 | 3.02 |
| AD-1534665.1 | 5.73 | 0.32 | 14.01 | 0.67 | 21.39 | 1.31 |
| AD-1631309.1 | 7.03 | 0.66 | 14.67 | 0.88 | 21.63 | 2.28 |
| AD-1534621.1 | 6.70 | 0.50 | 17.96 | 4.44 | 17.38 | 0.96 |
| AD-1631300.1 | 10.06 | 1.77 | 17.60 | 1.48 | 24.79 | 2.03 |
| AD-1534506.1 | 6.24 | 0.92 | 13.38 | 1.17 | 20.59 | 0.68 |
| AD-1534507.1 | 10.74 | 0.98 | 15.73 | 1.15 | 24.57 | 3.14 |
| AD-1534627.1 | 25.35 | 2.73 | 43.05 | 3.27 | 60.05 | 4.14 |
| AD-1534628.1 | 41.16 | 3.47 | 63.30 | 4.02 | 73.10 | 3.82 |
| AD-1534643.1 | 59.52 | 1.86 | 79.54 | 3.61 | 74.34 | 4.06 |
| AD-1534477.1 | 9.74 | 1.31 | 21.58 | 1.03 | 33.46 | 3.63 |
| AD-1534478.1 | 49.87 | 2.04 | 63.36 | 2.03 | 85.92 | 4.39 |
| AD-1534525.1 | 25.71 | 2.68 | 48.60 | 7.18 | 60.80 | 3.95 |
| AD-1534519.1 | 67.15 | 5.73 | 75.69 | 8.82 | 88.37 | 5.21 |
| AD-1534501.1 | 7.52 | 1.75 | 15.11 | 1.03 | 22.92 | 1.42 |
| AD-1534502.1 | 8.00 | 0.87 | 15.90 | 1.77 | 26.14 | 2.65 |
| AD-1534619.1 | 11.28 | 0.97 | 25.24 | 2.79 | 30.78 | 3.45 |
| AD-1534585.1 | 11.34 | 0.38 | 21.88 | 1.41 | 27.59 | 3.05 |
| AD-1534638.1 | 17.72 | 1.81 | 27.67 | 0.63 | 33.57 | 2.93 |
| AD-1534639.1 | 20.54 | 3.14 | 29.81 | 1.93 | 37.26 | 6.55 |
| AD-1534471.1 | 6.51 | 0.69 | 12.63 | 1.00 | 22.48 | 2.27 |
| AD-1534515.1 | 16.51 | 1.81 | 32.66 | 10.43 | 32.77 | 3.57 |
| AD-1534498.1 | 10.26 | 1.63 | 19.40 | 2.23 | 32.84 | 4.14 |
| AD-1534611.1 | 5.59 | 0.50 | 14.54 | 2.13 | 20.10 | 1.53 |
| AD-1534567.1 | 3.99 | 0.33 | 11.49 | 2.11 | 13.54 | 1.29 |
| AD-1534653.1 | 12.81 | 1.20 | 21.70 | 1.26 | 32.04 | 0.85 |
| AD-1534582.1 | 4.41 | 0.68 | 15.00 | 3.15 | 18.57 | 2.10 |
| AD-1631290.1 | 7.40 | 0.51 | 16.85 | 0.91 | 24.34 | 1.01 |
| AD-1534468.1 | 12.06 | 1.11 | 25.04 | 1.77 | 34.73 | 3.53 |
| AD-1631272.1 | 21.96 | 0.94 | 33.00 | 3.29 | 37.18 | 2.22 |
| AD-1534491.1 | 5.19 | 0.37 | 13.84 | 1.96 | 21.60 | 1.19 |
| AD-1534584.1 | 10.01 | 0.57 | 26.72 | 4.03 | 34.05 | 4.78 |
| AD-1534475.1 | 34.84 | 2.54 | 55.91 | 4.77 | 80.78 | 1.98 |
| AD-1534479.1 | 5.79 | 0.57 | 12.45 | 0.83 | 20.10 | 1.83 |
| AD-1534631.1 | 9.40 | 1.46 | 18.99 | 0.61 | 29.08 | 2.89 |
| AD-1534528.1 | 5.96 | 0.99 | 11.36 | 0.79 | 18.28 | 1.72 |
| AD-1534500.1 | 54.63 | 8.31 | 61.60 | 0.80 | 78.36 | 3.61 |
| AD-1534571.1 | 7.52 | 1.01 | 17.48 | 3.54 | 20.30 | 1.81 |
| AD-1534670.1 | 34.73 | 3.06 | 44.58 | 6.06 | 52.88 | 1.88 |
| AD-1534535.1 | 28.24 | 0.99 | 43.88 | 2.96 | 63.88 | 3.07 |
| AD-1631281.1 | 49.87 | 6.19 | 69.66 | 4.09 | 82.29 | 8.76 |
| AD-1534536.1 | 85.33 | 11.49 | 81.33 | 3.08 | 90.47 | 3.99 |
| AD-1534520.1 | 54.45 | 4.62 | 64.37 | 4.70 | 78.68 | 15.12 |
| AD-1534474.1 | 47.54 | 4.63 | 75.38 | 3.44 | 88.71 | 13.21 |
| AD-1534516.1 | 39.65 | 4.68 | 59.02 | 2.12 | 75.27 | 2.71 |
| AD-1534463.1 | 69.01 | 3.89 | 53.48 | 2.10 | 63.99 | 6.25 |
| AD-1534513.1 | 83.25 | 15.32 | 77.18 | 16.79 | 81.45 | 9.40 |
| AD-1534677.1 | 88.76 | 4.69 | 76.94 | 2.75 | 86.09 | 3.80 |
| AD-1534620.1 | 40.56 | 4.37 | 52.67 | 3.28 | 61.12 | 8.69 |
| AD-1534497.1 | 20.56 | 1.70 | 39.51 | 2.12 | 61.93 | 3.33 |
| AD-1534599.1 | 22.24 | 1.26 | 33.58 | 1.07 | 35.83 | 1.27 |
| AD-1534539.1 | 15.85 | 1.61 | 28.76 | 6.80 | 35.78 | 2.40 |
| AD-1534517.1 | 17.72 | 1.90 | 23.72 | 2.15 | 33.03 | 0.61 |
| AD-1534579.1 | 16.26 | 2.41 | 24.17 | 3.87 | 28.24 | 3.91 |
| AD-1534524.1 | 10.59 | 0.91 | 16.19 | 2.05 | 30.88 | 3.69 |
| AD-1534573.1 | 31.99 | 3.60 | 47.90 | 1.48 | 46.22 | 5.02 |
| AD-1534671.1 | 43.31 | 2.22 | 53.10 | 5.75 | 71.83 | 10.58 |
| AD-1534651.1 | 70.56 | 7.43 | 64.51 | 4.91 | 67.31 | 4.94 |
| AD-85525.11 | 14.68 | 2.89 | 25.29 | 0.71 | 29.25 | 2.79 |
| AD-1534462.1 | 14.29 | 0.98 | 26.48 | 2.15 | 37.09 | 3.81 |
| AD-1534490.1 | 11.99 | 0.21 | 25.71 | 1.39 | 39.22 | 2.55 |
| AD-1534472.1 | 17.33 | 0.82 | 27.11 | 1.94 | 46.36 | 2.38 |
| AD-1534617.1 | 23.19 | 1.41 | 42.01 | 11.05 | 54.20 | 5.66 |
| AD-1631299.1 | 24.00 | 2.03 | 33.21 | 3.53 | 44.13 | 2.46 |
| AD-1534578.1 | 76.95 | 9.07 | 96.34 | 10.63 | 86.34 | 4.96 |
| AD-1534679.1 | 48.99 | 2.74 | 70.38 | 4.13 | 83.54 | 2.17 |
| AD-1631312.1 | 32.27 | 2.68 | 45.09 | 5.43 | 57.26 | 1.81 |
| AD-1534676.1 | 33.71 | 2.91 | 45.46 | 5.28 | 56.88 | 5.20 |
| AD-1631306.1 | 23.23 | 0.77 | 32.22 | 2.00 | 42.10 | 5.65 |
| AD-1534654.1 | 24.93 | 2.14 | 40.86 | 4.67 | 51.55 | 3.84 |
| AD-1534586.1 | 9.45 | 1.12 | 20.64 | 3.59 | 27.92 | 1.46 |
| AD-1631291.1 | 11.51 | 1.14 | 20.31 | 2.19 | 28.60 | 2.23 |
| AD-1534467.1 | 5.30 | 0.63 | 12.78 | 0.40 | 20.64 | 1.07 |
| AD-1534466.1 | 26.06 | 0.15 | 45.65 | 3.89 | 60.77 | 6.19 |
| AD-1534489.1 | 33.87 | 3.66 | 66.95 | 5.67 | 87.84 | 9.58 |
| AD-1534469.1 | 55.57 | 4.56 | 68.07 | 7.11 | 89.20 | 6.12 |
| AD-1534595.1 | 55.23 | 2.75 | 69.66 | 7.29 | 70.81 | 6.57 |
| AD-1534529.1 | 101.12 | 7.09 | 87.33 | 3.56 | 102.13 | 4.30 |
| AD-1534672.1 | 72.47 | 5.94 | 64.77 | 3.99 | 83.59 | 3.66 |
| AD-1534666.1 | 63.91 | 6.67 | 76.11 | 4.79 | 86.79 | 5.64 |
| AD-1534597.1 | 49.56 | 3.29 | 89.70 | 12.87 | 96.87 | 8.59 |
| AD-1631292.1 | 51.62 | 7.41 | 71.35 | 3.78 | 86.68 | 3.55 |

TABLE 4-continued

Single Dose Screen in PHH Cells

| Duplex ID | 10 nM | ST DEVP | 1 nM | ST DEVP | 0.1 nM | ST DEVP |
|---|---|---|---|---|---|---|
| AD-1534537.1 | 29.30 | 2.87 | 40.25 | 4.60 | 62.01 | 2.78 |
| AD-1534526.1 | 60.24 | 4.43 | 95.64 | 5.54 | 110.26 | 5.46 |
| AD-1534493.1 | 21.43 | 1.40 | 34.04 | 3.79 | 56.91 | 5.89 |
| AD-1534588.1 | 44.54 | 5.12 | 70.83 | 12.48 | 67.02 | 3.48 |
| AD-1534511.1 | 22.85 | 1.44 | 44.49 | 8.24 | 61.39 | 4.77 |
| AD-1534660.1 | 74.45 | 5.23 | 80.92 | 3.39 | 94.10 | 9.13 |
| AD-1534534.1 | 22.93 | 0.28 | 39.25 | 2.24 | 61.05 | 2.64 |
| AD-1534634.1 | 93.70 | 4.94 | 96.32 | 8.44 | 111.83 | 41.06 |
| AD-1534659.1 | 37.46 | 5.93 | 53.76 | 6.38 | 64.44 | 4.47 |
| AD-1534626.1 | 111.67 | 28.84 | 122.51 | 2.77 | 92.76 | 14.98 |
| AD-1534470.1 | 41.78 | 7.90 | 44.45 | 4.38 | 62.80 | 6.14 |
| AD-1534499.1 | 69.72 | 3.78 | 62.83 | 11.66 | 82.50 | 8.57 |
| AD-1534612.1 | 59.51 | 6.06 | 102.44 | 11.86 | 109.07 | 8.44 |
| AD-1534656.1 | 95.76 | 9.13 | 102.62 | 7.53 | 110.72 | 12.77 |
| AD-1534570.1 | 45.17 | 2.30 | 61.43 | 4.73 | 66.64 | 4.62 |
| AD-1534546.1 | 30.42 | 2.00 | 44.54 | 2.58 | 63.28 | 2.03 |
| AD-1631283.1 | 53.77 | 7.68 | 66.21 | 5.15 | 81.68 | 2.33 |
| AD-1534547.1 | 73.39 | 6.72 | 69.85 | 3.20 | 83.71 | 6.41 |
| AD-1534556.1 | 28.70 | 2.96 | 36.69 | 2.47 | 44.55 | 3.73 |
| AD-1534580.1 | 46.19 | 5.80 | 70.43 | 6.94 | 79.60 | 5.28 |
| AD-1534464.1 | 14.54 | 0.91 | 23.22 | 3.19 | 36.06 | 2.74 |
| AD-1534482.1 | 105.24 | 4.35 | 99.89 | 10.63 | 113.69 | 7.62 |
| AD-1534540.1 | 56.22 | 2.62 | 71.10 | 5.57 | 95.48 | 9.44 |
| AD-1534541.1 | 58.76 | 1.47 | 78.48 | 10.61 | 87.69 | 3.78 |
| AD-1534509.1 | 111.13 | 12.91 | 98.75 | 3.75 | 120.57 | 7.80 |
| AD-1534655.1 | 75.99 | 10.47 | 82.03 | 2.89 | 94.00 | 6.37 |
| AD-1534505.1 | 50.27 | 4.39 | 53.63 | 1.20 | 67.81 | 1.73 |
| AD-1534616.1 | 63.20 | 4.69 | 90.91 | 9.30 | 85.72 | 6.44 |
| AD-1534674.1 | 46.60 | 5.31 | 61.18 | 5.37 | 77.75 | 4.04 |
| AD-1534603.1 | 57.38 | 3.04 | 71.07 | 8.17 | 76.83 | 11.06 |
| AD-1534557.1 | 49.28 | 10.63 | 61.58 | 6.28 | 61.57 | 3.16 |
| AD-1534624.1 | 37.25 | 4.11 | 46.55 | 3.61 | 58.11 | 11.13 |
| AD-1534605.1 | 38.22 | 2.61 | 52.90 | 2.33 | 57.25 | 5.66 |
| AD-1534648.1 | 23.28 | 0.90 | 36.75 | 0.48 | 43.91 | 5.12 |
| AD-1534545.1 | 8.12 | 0.79 | 18.64 | 3.89 | 39.39 | 11.63 |
| AD-1631282.1 | 17.87 | 1.46 | 25.82 | 1.70 | 33.53 | 1.13 |
| AD-1534591.1 | 11.90 | 2.88 | 25.25 | 7.53 | 27.05 | 2.76 |
| AD-1534518.1 | 14.37 | 0.54 | 23.94 | 2.38 | 39.01 | 3.34 |
| AD-1534492.1 | 22.26 | 1.86 | 42.88 | 5.64 | 64.28 | 4.43 |
| AD-1534587.1 | 31.44 | 6.31 | 64.88 | 7.94 | 67.09 | 4.43 |
| AD-1534632.1 | 31.89 | 5.60 | 51.77 | 5.88 | 61.77 | 7.49 |
| AD-1534633.1 | 25.37 | 1.39 | 39.39 | 1.51 | 50.81 | 7.80 |
| AD-1631303.1 | 33.26 | 2.26 | 41.62 | 3.79 | 57.71 | 7.24 |
| AD-1534576.1 | 29.90 | 4.81 | 48.65 | 5.92 | 56.26 | 2.84 |
| AD-1631289.1 | 30.28 | 4.57 | 40.69 | 2.13 | 59.53 | 3.03 |
| AD-1631311.1 | 33.11 | 1.82 | 45.93 | 3.49 | 57.99 | 2.57 |
| AD-1534675.1 | 39.66 | 4.13 | 41.94 | 1.18 | 50.88 | 3.23 |
| AD-1534560.1 | 52.00 | 5.20 | 80.40 | 16.47 | 64.60 | 2.84 |
| AD-1534640.1 | 55.00 | 5.33 | 66.23 | 6.74 | 77.75 | 7.61 |
| AD-1534480.1 | 51.85 | 0.44 | 71.51 | 1.59 | 90.26 | 2.48 |
| AD-1631274.1 | 87.27 | 7.50 | 109.28 | 6.04 | 108.52 | 11.21 |
| AD-1534481.1 | 67.88 | 8.36 | 72.24 | 9.31 | 98.31 | 4.10 |
| AD-1631275.1 | 101.48 | 8.70 | 97.91 | 9.77 | 107.97 | 6.90 |
| AD-1534527.1 | 30.30 | 1.72 | 34.31 | 2.33 | 59.43 | 6.24 |
| AD-1534494.1 | 50.99 | 8.88 | 64.25 | 2.23 | 77.92 | 2.68 |
| AD-1534593.1 | 42.30 | 4.13 | 70.83 | 4.22 | 84.34 | 2.97 |
| AD-1534594.1 | 95.11 | 15.44 | 120.35 | 13.47 | 96.58 | 5.41 |
| AD-1534523.1 | 20.73 | 2.38 | 35.28 | 4.19 | 52.64 | 4.37 |
| AD-1534485.1 | 11.58 | 2.09 | 21.66 | 4.21 | 30.97 | 4.40 |
| AD-1534668.1 | 62.38 | 4.22 | 69.11 | 4.86 | 78.53 | 3.23 |
| AD-1631301.1 | 55.40 | 2.99 | 76.96 | 3.34 | 93.86 | 6.65 |
| AD-1534625.1 | 62.75 | 4.49 | 95.80 | 8.19 | 89.76 | 22.82 |
| AD-1534609.1 | 31.94 | 6.22 | 49.22 | 5.02 | 81.17 | 11.88 |
| AD-1631298.1 | 32.28 | 0.71 | 49.57 | 2.43 | 67.87 | 2.30 |
| AD-1534610.1 | 66.61 | 10.90 | 85.27 | 7.31 | 83.15 | 7.74 |
| AD-1534566.1 | 30.57 | 1.26 | 50.48 | 4.59 | 61.07 | 7.08 |
| AD-1534652.1 | 56.37 | 4.36 | 80.74 | 2.00 | 101.95 | 2.26 |
| AD-1534636.1 | 39.83 | 3.63 | 47.37 | 6.03 | 66.01 | 2.11 |
| AD-1631304.1 | 58.79 | 5.17 | 71.58 | 5.61 | 89.88 | 6.49 |
| AD-1534637.1 | 78.43 | 10.72 | 81.46 | 2.87 | 98.09 | 7.91 |
| AD-1631307.1 | 32.14 | 4.23 | 40.25 | 4.31 | 53.35 | 2.05 |
| AD-1534662.1 | 39.36 | 1.75 | 56.21 | 4.92 | 65.12 | 2.72 |
| AD-1534602.1 | 71.84 | 2.85 | 87.49 | 7.15 | 96.69 | 21.16 |
| AD-1631295.1 | 75.13 | 9.72 | 82.13 | 8.33 | 98.16 | 10.17 |
| AD-1534646.1 | 74.39 | 8.40 | 79.91 | 2.36 | 88.50 | 8.43 |
| AD-1534555.1 | 14.19 | 2.04 | 21.78 | 2.32 | 24.72 | 4.67 |
| AD-1534606.1 | 22.38 | 2.44 | 41.68 | 6.48 | 48.18 | 5.88 |
| AD-1534565.1 | 15.15 | 1.05 | 27.81 | 3.52 | 36.49 | 4.85 |
| AD-1534649.1 | 32.03 | 2.33 | 42.71 | 2.10 | 55.30 | 1.28 |
| AD-1534549.1 | 37.16 | 3.08 | 53.88 | 1.01 | 56.37 | 5.70 |
| AD-1631284.1 | 58.27 | 4.92 | 73.77 | 4.58 | 89.86 | 12.68 |
| AD-1534550.1 | 64.40 | 2.40 | 76.19 | 4.60 | 67.48 | 3.22 |
| AD-1534572.1 | 70.78 | 8.37 | 101.43 | 14.08 | 82.58 | 5.38 |
| AD-1534630.1 | 27.27 | 1.95 | 55.63 | 5.09 | 66.82 | 5.46 |
| AD-1534629.1 | 30.89 | 2.17 | 44.31 | 4.68 | 53.39 | 2.22 |
| AD-1631302.1 | 42.51 | 4.16 | 65.86 | 6.21 | 84.55 | 1.75 |
| AD-1534650.1 | 24.92 | 3.62 | 44.74 | 3.33 | 49.68 | 1.53 |
| AD-1631305.1 | 26.38 | 1.33 | 38.75 | 1.67 | 48.40 | 1.43 |
| AD-1534554.1 | 36.30 | 3.47 | 49.15 | 4.29 | 54.07 | 2.93 |
| AD-1631285.1 | 45.99 | 4.16 | 53.92 | 4.59 | 71.46 | 1.05 |
| AD-1534600.1 | 21.88 | 1.47 | 36.18 | 6.87 | 40.92 | 0.57 |
| AD-1631293.1 | 32.31 | 3.00 | 40.47 | 3.64 | 60.50 | 6.29 |
| AD-1534551.1 | 27.52 | 1.50 | 51.79 | 5.47 | 50.75 | 4.67 |
| AD-1534575.1 | 30.21 | 1.40 | 59.31 | 4.42 | 66.58 | 6.66 |
| AD-1534673.1 | 88.45 | 7.15 | 96.79 | 5.22 | 97.59 | 5.35 |
| AD-1534486.1 | 97.44 | 8.32 | 83.05 | 7.44 | 91.03 | 5.44 |
| AD-1534645.1 | 92.81 | 4.34 | 97.75 | 7.27 | 94.46 | 1.87 |
| AD-1534548.1 | 54.84 | 3.66 | 61.01 | 4.40 | 72.69 | 6.52 |
| AD-1534512.1 | 41.38 | 4.05 | 49.95 | 5.89 | 72.18 | 11.00 |
| AD-1534607.1 | 22.41 | 3.51 | 41.77 | 6.21 | 50.84 | 4.56 |
| AD-1631297.1 | 34.17 | 0.45 | 45.39 | 2.50 | 65.66 | 1.88 |
| AD-1534608.1 | 71.59 | 2.79 | 93.51 | 12.94 | 88.83 | 6.00 |
| AD-1534559.1 | 67.09 | 14.06 | 88.92 | 9.40 | 67.72 | 9.79 |
| AD-1631286.1 | 85.82 | 7.69 | 101.72 | 9.46 | 104.03 | 5.31 |
| AD-1534613.1 | 48.97 | 1.67 | 81.30 | 3.49 | 89.54 | 4.96 |
| AD-1534644.1 | 71.22 | 12.37 | 74.84 | 2.89 | 82.63 | 6.72 |
| AD-1534521.1 | 95.41 | 5.25 | 91.24 | 10.80 | 87.94 | 7.81 |
| AD-1534483.1 | 18.60 | 0.72 | 29.29 | 2.89 | 48.24 | 2.38 |
| AD-1631276.1 | 28.16 | 3.11 | 38.22 | 4.72 | 46.80 | 4.46 |
| AD-1534542.1 | 32.16 | 4.33 | 42.12 | 3.99 | 76.81 | 4.74 |
| AD-1534569.1 | 24.90 | 1.57 | 37.58 | 2.47 | 37.74 | 4.56 |
| AD-1534657.1 | 68.98 | 9.23 | 83.63 | 3.46 | 86.67 | 3.28 |
| AD-1534658.1 | 87.50 | 6.51 | 92.64 | 4.12 | 103.85 | 12.76 |
| AD-1534510.1 | 66.95 | 12.63 | 76.26 | 6.81 | 109.70 | 8.76 |
| AD-1534614.1 | 22.17 | 1.33 | 35.69 | 1.44 | 39.16 | 1.94 |
| AD-1534574.1 | 88.89 | 3.27 | 110.60 | 9.42 | 90.50 | 12.65 |
| AD-1534635.1 | 97.55 | 11.72 | 99.79 | 11.64 | 79.32 | 6.76 |
| AD-1534669.1 | 100.48 | 6.95 | 96.71 | 3.35 | 105.96 | 3.90 |
| AD-1534583.1 | 40.12 | 6.39 | 53.52 | 6.93 | 74.22 | 3.31 |
| AD-1534484.1 | 29.17 | 1.79 | 45.44 | 3.20 | 74.06 | 9.81 |
| AD-1631277.1 | 45.53 | 6.63 | 51.88 | 3.05 | 64.54 | 4.20 |
| AD-1534544.1 | 9.80 | 0.90 | 16.59 | 2.33 | 26.79 | 2.32 |
| AD-1534552.1 | 11.79 | 0.84 | 18.76 | 1.61 | 21.40 | 1.21 |
| AD-1534495.1 | 27.51 | 0.57 | 34.36 | 2.18 | 49.08 | 4.64 |
| AD-1534496.1 | 59.63 | 5.55 | 71.87 | 4.27 | 85.96 | 9.83 |
| AD-1534598.1 | 27.36 | 0.93 | 46.88 | 3.64 | 60.96 | 0.21 |
| AD-1534538.1 | 16.64 | 0.97 | 28.96 | 7.93 | 36.95 | 3.66 |
| AD-1534532.1 | 37.38 | 7.38 | 53.22 | 5.16 | 79.64 | 4.48 |
| AD-1534504.1 | 33.37 | 2.43 | 63.89 | 10.64 | 78.46 | 2.75 |
| AD-1534622.1 | 24.91 | 1.70 | 37.38 | 2.39 | 46.48 | 4.99 |
| AD-1534623.1 | 38.76 | 3.45 | 59.33 | 3.08 | 63.85 | 6.29 |
| AD-1534558.1 | 21.15 | 5.51 | 38.81 | 8.73 | 35.65 | 4.91 |
| AD-1534476.1 | 100.42 | 3.72 | 103.32 | 7.53 | 112.28 | 15.47 |
| AD-1534522.1 | 97.52 | 9.13 | 90.32 | 9.05 | 103.24 | 11.99 |
| AD-1534543.1 | 23.40 | 3.30 | 31.89 | 5.31 | 62.63 | 5.62 |
| AD-1631310.1 | 42.04 | 3.06 | 69.53 | 5.72 | 77.18 | 5.51 |
| AD-1534667.1 | 79.92 | 5.34 | 85.29 | 6.91 | 89.36 | 1.42 |
| AD-1534642.1 | 56.02 | 4.92 | 59.10 | 1.21 | 64.92 | 5.08 |
| AD-1534487.1 | 57.71 | 2.85 | 82.81 | 4.42 | 101.67 | 8.02 |
| AD-1531278.1 | 65.24 | 7.94 | 87.91 | 5.94 | 92.85 | 5.90 |
| AD-1534561.1 | 21.42 | 0.17 | 45.34 | 4.28 | 52.27 | 6.74 |
| AD-1631287.1 | 58.56 | 3.21 | 82.99 | 4.93 | 100.17 | 5.77 |
| AD-1534641.1 | 73.86 | 8.50 | 84.35 | 7.79 | 86.67 | 8.05 |
| AD-1534568.1 | 28.20 | 3.72 | 37.09 | 3.62 | 36.20 | 6.63 |
| AD-1534590.1 | 45.61 | 4.96 | 65.21 | 2.09 | 64.08 | 8.72 |
| AD-1534514.1 | 9.15 | 0.81 | 20.79 | 7.75 | 21.40 | 3.78 |
| AD-1631279.1 | 15.09 | 1.83 | 24.40 | 1.84 | 29.12 | 3.14 |
| AD-1534663.1 | 17.43 | 2.55 | 33.15 | 2.30 | 38.35 | 3.26 |
| AD-1631308.1 | 18.85 | 2.28 | 26.52 | 1.35 | 32.51 | 3.61 |

TABLE 4-continued

Single Dose Screen in PHH Cells

| Duplex ID | 10 nM | ST DEVP | 1 nM | ST DEVP | 0.1 nM | ST DEVP |
|---|---|---|---|---|---|---|
| AD-1534664.1 | 45.68 | 5.11 | 69.10 | 4.79 | 72.27 | 3.37 |
| AD-1534604.1 | 22.49 | 2.74 | 37.81 | 4.80 | 43.88 | 1.36 |
| AD-1631296.1 | 28.83 | 3.32 | 41.33 | 4.52 | 56.38 | 4.98 |
| AD-1534564.1 | 11.94 | 0.63 | 26.23 | 3.96 | 30.49 | 2.09 |
| AD-1631288.1 | 25.02 | 0.26 | 31.89 | 4.09 | 44.86 | 1.53 |
| AD-1534647.1 | 24.19 | 3.90 | 36.83 | 2.48 | 47.37 | 4.84 |
| AD-1534533.1 | 13.64 | 1.69 | 23.78 | 1.15 | 34.73 | 2.94 |
| AD-1631280.1 | 22.71 | 3.94 | 33.78 | 1.19 | 40.60 | 5.98 |
| AD-1534531.1 | 56.59 | 2.28 | 56.07 | 2.84 | 77.08 | 1.45 |
| AD-1534503.1 | 101.70 | 5.18 | 99.76 | 6.60 | 104.76 | 9.28 |
| AD-1534589.1 | 31.00 | 2.96 | 39.68 | 4.48 | 33.08 | 4.27 |
| AD-1534601.1 | 22.70 | 4.11 | 34.40 | 5.02 | 32.23 | 5.36 |
| AD-1631294.1 | 29.61 | 4.32 | 31.06 | 5.07 | 41.95 | 4.70 |
| AD-1534553.1 | 11.13 | 0.74 | 17.12 | 2.96 | 21.57 | 2.04 |
| AD-1534596.1 | 37.73 | 2.95 | 59.86 | 3.33 | 70.31 | 2.58 |
| AD-1534530.1 | 7.36 | 0.65 | 16.61 | 1.33 | 23.87 | 2.58 |
| AD-1534618.1 | 12.56 | 1.50 | 27.00 | 2.97 | 29.22 | 2.76 |
| AD-1534581.1 | 9.22 | 1.37 | 15.93 | 2.05 | 24.66 | 3.16 |
| AD-85541.7 | 13.70 | 3.06 | 23.70 | 1.93 | 34.59 | 4.55 |
| AD-85541.8 | 21.00 | 1.70 | 34.00 | 4.71 | 39.06 | 4.06 |
| AD-85541.9 | 24.54 | 2.01 | 30.34 | 1.23 | 36.28 | 2.05 |
| AD-1534465.1 | 10.13 | 1.67 | 21.35 | 3.86 | 27.79 | 2.47 |
| AD-1534488.1 | 14.81 | 2.55 | 25.05 | 2.54 | 39.86 | 4.32 |
| AD-1534562.1 | 12.89 | 0.79 | 23.06 | 1.66 | 30.15 | 2.35 |
| AD-85537.26 | 16.08 | 2.94 | 30.40 | 7.02 | 31.69 | 0.91 |
| AD-1534563.1 | 19.54 | 1.26 | 28.43 | 5.85 | 32.33 | 3.44 |
| AD-85531.33 | 9.59 | 1.14 | 16.37 | 1.69 | 27.63 | 2.32 |
| AD-85531.34 | 11.63 | 1.13 | 25.34 | 3.07 | 25.90 | 1.56 |
| AD-85531.35 | 14.41 | 0.76 | 21.61 | 0.97 | 25.76 | 5.03 |
| AD-1534473.1 | 8.34 | 1.93 | 19.25 | 1.09 | 24.74 | 3.16 |
| AD-1631273.1 | 14.39 | 1.20 | 24.40 | 1.84 | 30.21 | 2.02 |
| AD-67246.37 | 17.29 | 1.51 | 32.62 | 4.37 | 48.98 | 6.48 |
| AD-67246.39 | 26.36 | 0.60 | 36.55 | 3.64 | 41.01 | 1.88 |
| AD-67246.38 | 27.36 | 3.49 | 36.80 | 3.65 | 41.07 | 4.79 |
| AD-1534508.1 | 16.93 | 2.35 | 29.16 | 1.21 | 37.18 | 2.49 |

TABLE 5

Single Dose Screen in PCH Cells (Transfection)

| Duplex ID | 10 nM | ST DEVP | 1 nM | ST DEVP | 0.1 nM | ST DEVP |
|---|---|---|---|---|---|---|
| AD-1534465 | 18.28 | 2.59 | 15.45 | 4.14 | 45.78 | 2.05 |
| AD-1534467 | 12.07 | 3.10 | 6.05 | 2.30 | 30.98 | 4.37 |
| AD-1534471 | 16.33 | 1.87 | 26.32 | 5.91 | 33.02 | 5.65 |
| AD-1534473 | 21.00 | 7.01 | 12.36 | 2.50 | 30.99 | 8.28 |
| AD-1534479 | 14.34 | 2.96 | 17.49 | 2.45 | 23.12 | 4.90 |
| AD-1534485 | 18.04 | 3.77 | 18.63 | 3.07 | 39.26 | 5.50 |
| AD-1534491 | 15.63 | 3.10 | 14.30 | 0.62 | 27.53 | 3.54 |
| AD-1534501 | 19.41 | 4.66 | 23.53 | 9.64 | 37.27 | 5.39 |
| AD-1534502 | 22.47 | 5.56 | 24.66 | 3.53 | 42.18 | 6.77 |
| AD-1534506 | 15.83 | 4.58 | 17.68 | 2.11 | 31.63 | 2.75 |
| AD-1534507 | 22.94 | 2.67 | 18.38 | 1.38 | 47.06 | 11.33 |
| AD-1534514 | 13.19 | 2.76 | 12.59 | 2.91 | 34.32 | 9.35 |
| AD-1534528 | 9.97 | 0.51 | 7.92 | 1.46 | 32.13 | 3.41 |
| AD-1534530 | 14.33 | 2.80 | 11.59 | 1.97 | 39.65 | 8.17 |
| AD-1534544 | 22.56 | 1.46 | 21.96 | 5.92 | 40.59 | 5.23 |
| AD-1534552 | 20.31 | 6.06 | 20.69 | 2.53 | 44.00 | 7.98 |
| AD-1534553 | 19.61 | 6.51 | 14.53 | 2.92 | 37.40 | 3.63 |
| AD-1534555 | 25.83 | 5.93 | 20.51 | 6.09 | 41.03 | 7.75 |
| AD-1534562 | 23.80 | 5.39 | 21.31 | 3.20 | 43.33 | 7.54 |
| AD-1534564 | 31.11 | 6.46 | 16.14 | 2.26 | 50.02 | 2.49 |
| AD-1534567 | 13.12 | 2.13 | 14.23 | 2.49 | 32.72 | 1.77 |
| AD-1534571 | 11.59 | 2.16 | 12.09 | 2.09 | 27.03 | 5.12 |
| AD-1534577 | 23.92 | 4.59 | 25.94 | 6.11 | 35.58 | 6.86 |
| AD-1534579 | 25.22 | 1.77 | 23.60 | 2.32 | 51.23 | 17.17 |
| AD-1534581 | 16.65 | 3.40 | 20.77 | 1.77 | 36.46 | 8.19 |
| AD-1534582 | 15.20 | 1.36 | 11.39 | 2.15 | 24.75 | 5.88 |
| AD-1534585 | 27.97 | 5.53 | 21.50 | 5.56 | 41.44 | 5.78 |
| AD-1534586 | 21.38 | 2.25 | 15.24 | 3.56 | 35.81 | 5.46 |
| AD-1534591 | 22.21 | 4.44 | 11.47 | 2.83 | 39.13 | 14.38 |
| AD-1534611 | 21.54 | 5.60 | 16.92 | 5.02 | 26.32 | 3.67 |
| AD-1534618 | 12.24 | 1.49 | 17.18 | 1.28 | 23.62 | 3.38 |
| AD-1534619 | 28.85 | 4.69 | 23.37 | 7.36 | 48.40 | 6.21 |
| AD-1534621 | 19.40 | 3.69 | 18.97 | 3.45 | 34.18 | 10.17 |
| AD-1534631 | 21.33 | 5.30 | 18.94 | 6.73 | 35.68 | 7.14 |
| AD-1534653 | 19.84 | 2.61 | 10.18 | 1.16 | 37.95 | 7.51 |
| AD-1534665 | 18.23 | 3.25 | 18.42 | 2.70 | 23.38 | 2.41 |
| AD-1534678 | 18.35 | 3.52 | 21.08 | 2.66 | 53.65 | 27.11 |
| AD-1631290 | 11.66 | 1.99 | 11.86 | 2.45 | 20.87 | 4.45 |
| AD-1631291 | 20.88 | 6.70 | 14.34 | 3.15 | 32.19 | 7.09 |
| AD-1631300 | 15.46 | 2.62 | 15.49 | 2.16 | 27.01 | 4.53 |
| AD-1631309 | 22.31 | 5.30 | 16.15 | 2.09 | 29.91 | 6.11 |
| AD-85525 | 20.67 | 1.13 | 18.92 | 2.46 | 31.87 | 7.27 |
| AD-85531 | 18.32 | 4.78 | 14.89 | 2.49 | 35.11 | 5.44 |

TABLE 6

Single Dose Screen in PCH Cells (Free Uptake)

| DuplexID | 250 nM | ST DEVP | 100 nM | ST DEVP | 10 nM | ST DEVP | 1 nM | ST DEVP |
|---|---|---|---|---|---|---|---|---|
| AD-1534465 | 15.49 | 4.60 | 11.75 | 0.66 | 23.94 | 3.21 | 72.39 | 5.65 |
| AD-1534467 | 20.24 | 4.16 | 13.59 | 1.17 | 23.53 | 9.72 | 42.28 | 6.59 |
| AD-1534471 | 12.66 | 5.63 | 7.71 | 0.77 | 19.57 | 2.37 | 39.78 | 1.01 |
| AD-1534473 | 12.65 | 2.06 | 14.85 | 4.29 | 29.38 | 5.61 | 65.25 | 5.21 |
| AD-1534479 | 8.80 | 2.22 | 7.78 | 1.45 | 19.10 | 3.76 | 33.74 | 3.53 |
| AD-1534485 | 11.34 | 0.85 | 17.18 | 3.88 | 28.81 | 7.44 | 60.10 | 13.66 |
| AD-1534491 | 15.43 | 5.04 | 9.75 | 1.79 | 27.15 | 7.17 | 54.43 | 9.67 |
| AD-1534501 | 11.68 | 3.23 | 16.81 | 3.56 | 30.38 | 9.35 | 63.22 | 2.82 |
| AD-1534502 | 18.95 | 4.92 | 19.95 | 3.55 | 35.53 | 5.83 | 72.11 | 10.93 |
| AD-1534506 | 10.74 | 4.18 | 13.59 | 4.49 | 19.73 | 5.44 | 27.82 | 2.19 |
| AD-1534507 | 17.45 | 3.38 | 17.10 | 2.07 | 26.46 | 4.47 | 90.06 | 17.23 |
| AD-1534514 | 23.71 | 3.55 | 30.52 | 8.84 | 41.85 | 11.92 | 77.66 | 10.23 |
| AD-1534528 | 11.03 | 1.87 | 11.12 | 0.94 | 25.24 | 6.79 | 36.92 | 2.42 |
| AD-1534530 | 9.76 | 4.12 | 12.56 | 1.14 | 18.21 | 3.97 | 49.47 | 6.22 |
| AD-1534544 | 32.95 | 12.99 | 21.42 | 1.92 | 34.90 | 6.86 | 66.88 | 6.19 |
| AD-1534552 | 13.18 | 1.31 | 18.30 | 2.30 | 32.02 | 2.70 | 96.85 | 27.65 |
| AD-1534553 | 13.62 | 1.42 | 14.67 | 1.69 | 28.77 | 4.34 | 64.03 | 6.70 |
| AD-1534555 | 14.18 | 0.94 | 20.63 | 4.16 | 27.78 | 0.59 | 100.52 | 17.63 |
| AD-1534562 | 27.51 | 5.92 | 15.55 | 1.93 | 35.28 | 7.24 | 87.15 | 23.59 |
| AD-1534564 | 21.25 | 3.97 | 22.68 | 5.10 | 73.82 | 13.07 | 120.81 | 18.30 |
| AD-1534567 | 8.54 | 1.44 | 8.92 | 2.37 | 13.74 | 2.39 | 43.37 | 3.72 |

TABLE 6-continued

Single Dose Screen in PCH Cells (Free Uptake)

| DuplexID | 250 nM | ST DEVP | 100 nM | ST DEVP | 10 nM | ST DEVP | 1 nM | ST DEVP |
|---|---|---|---|---|---|---|---|---|
| AD-1534571 | 13.45 | 5.58 | 10.94 | 3.01 | 18.93 | 1.57 | 35.38 | 1.55 |
| AD-1534577 | 19.69 | 5.02 | 15.07 | 5.24 | 33.22 | 8.93 | 55.75 | 10.30 |
| AD-1534579 | 42.43 | 8.99 | 41.99 | 10.32 | 41.21 | 3.06 | 94.19 | 22.09 |
| AD-1534581 | 18.28 | 5.74 | 17.64 | 2.32 | 20.20 | 4.12 | 47.15 | 5.06 |
| AD-1534582 | 7.21 | 1.33 | 8.39 | 3.39 | 12.99 | 1.61 | 38.17 | 6.33 |
| AD-1534585 | 20.27 | 4.42 | 19.78 | 3.81 | 31.81 | 4.61 | 74.16 | 8.03 |
| AD-1534586 | 15.25 | 4.94 | 11.47 | 1.52 | 20.78 | 2.67 | 59.00 | 4.49 |
| AD-1534591 | 17.17 | 5.83 | 16.29 | 5.06 | 25.53 | 2.44 | 75.89 | 9.01 |
| AD-1534611 | 11.01 | 4.84 | 9.49 | 2.77 | 13.67 | 4.40 | 40.93 | 8.96 |
| AD-1534618 | 10.02 | 0.99 | 12.89 | 3.09 | 21.95 | 2.61 | 47.87 | 7.74 |
| AD-1534619 | 12.75 | 5.93 | 10.30 | 1.34 | 25.26 | 4.53 | 89.16 | 25.96 |
| AD-1534621 | 7.79 | 1.98 | 8.33 | 2.89 | 13.57 | 1.24 | 41.04 | 10.75 |
| AD-1534631 | 9.40 | 2.12 | 7.47 | 0.88 | 22.42 | 2.80 | 57.95 | 9.29 |
| AD-1534653 | 9.46 | 1.32 | 18.66 | 7.80 | 18.66 | 7.90 | 75.10 | 4.95 |
| AD-1534665 | 6.48 | 0.67 | 7.45 | 1.98 | 12.71 | 4.79 | 32.19 | 1.28 |
| AD-1534678 | 10.38 | 2.80 | 16.52 | 8.97 | 27.79 | 8.28 | 117.53 | 7.03 |
| AD-1631290 | 10.18 | 5.40 | 9.24 | 3.50 | 11.56 | 2.35 | 29.98 | 1.78 |
| AD-1631291 | 17.98 | 5.19 | 19.35 | 5.09 | 26.38 | 3.97 | 57.54 | 12.13 |
| AD-1631300 | 6.32 | 0.57 | 7.06 | 0.52 | 12.87 | 0.74 | 40.73 | 5.64 |
| AD-1631309 | 8.01 | 1.29 | 6.06 | 1.13 | 11.91 | 2.02 | 39.44 | 10.42 |
| AD-85525 | 28.43 | 7.95 | 27.87 | 9.26 | 30.92 | 7.75 | 84.19 | 18.23 |
| AD-85531 | 18.70 | 9.18 | 15.06 | 5.36 | 28.70 | 5.06 | 73.62 | 7.07 |

Example 3. Single Dose Screen in Humanized Mice

A single 0.2 mg/kg dose of duplexes of interest identified in the above in vitro studies in 1× PBS (AD-67244, AD-1534528, AD-1534582, AD-1534611, AD-1534479, AD-1534506, AD-1631309, AD-1534471, AD-1534555, or AD-1534678) were intravenously administered via tail vein injection to 36 week old mice (n=4) expressing human F12 mRNA (humanized F12 mice).

The unmodified nucleotide sequences of the sense and antisense strands of AD-67244 are:
5'-AACUCAAUAAAGUGCUUUGAA-3' (SEQ ID NO:13) and 5'-UUCAAAGCACUUUAUUGAGUUUC-3' (SQE DI NO:18); and the modified nucleotide sequences of the sense and antisense strands of AD-67244 are:
5'-asascucaAfuAfAfAfgugcuuugaa-3' (SEQ ID NO:19) and 5'-usUfscaaAfgCfAfcuuuAfuUfgaguususc-3' (SEQ ID NO:20).

At weekly intervals post-dose, up to six weeks post-dose, blood samples were collected with 3.8% sodium citrate (using a citrate-to-blood ratio of 1:9). Blood was processed for plasma within 45 minutes of collection, and plasma samples were frozen at −80° C. until human FXII (hFXII) protein was quantified using the Gryolab xP (BioAgilytix). The biotinylated capture and Alexa647-tagged detection monoclonal anti-hFXII antibodies used on the Gyrolab platform were H4H26029P and H4H26064P, respectively. Levels of human FXII protein in plasma samples were calibrated against a standard curve generated using hFXII (HFXII 1212, Enzyme Research Laboratories) and plotted in GraphPad Prism (Version 9.1.0) for each animal in each group of tested duplex as a function of time.

The results of these assays are presented in the Tables below and FIG. 1 and demonstrate that the duplexes potently and durably inhibit human Factor XII protein expression.

Example 4. Effects of siRNA-GalNAC Conjugates in Non-Human Primates

Duplexes of interest from the in vitro and in vivo studies described above were further investigated for their effectiveness in non-human primates. Specifically, a single 1 mg/kg or 3 mg/kg dose of the duplexes of interest was subcutaneously administered to Cynomolgus monkeys. Plasma samples were collected from the animals every week, and the plasma level of Factor XII (FXII) protein was determined by ELISA. Plasma samples were collected from each animal pre-dose (Day −3 and Day 1) and on Days 8, 15, 22, 29, 36, 43, 50, 57, 64, 71, 78, 85, 92, 99, 106, 113, and 120 post-dose. The data were normalized to the average of pre-dose (D-3 and D1). The D1 sample was taken on the day of administration of the first dose, but before administration.

Figure 2:
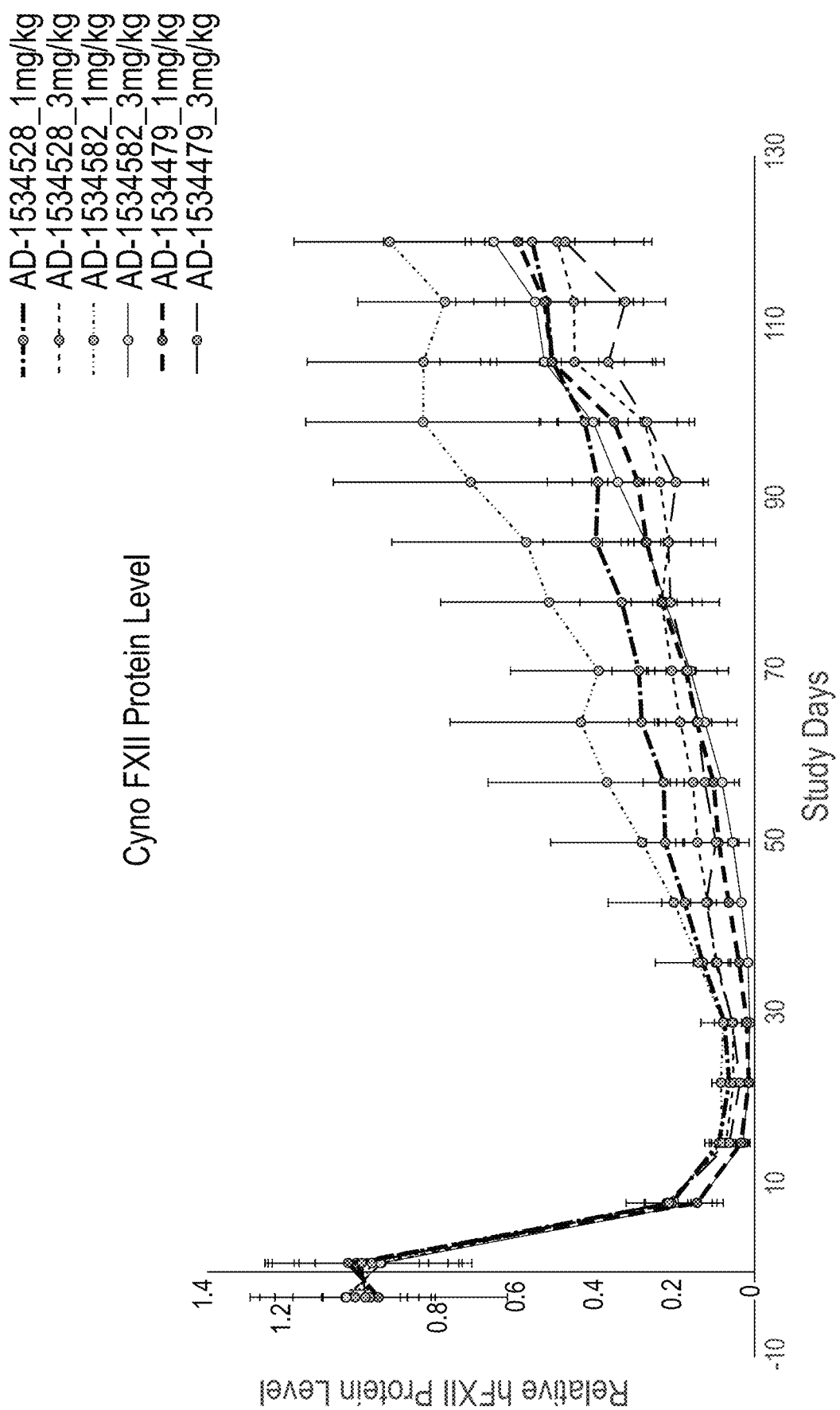
FIG. 2 is a graph depicting the percent change of FXII protein levels compared to the levels of Factor XII on the indicated dosing day in the serum of Cynomolgus monkeys subcutaneously administered a single 1 mg/kg of the indicated duplexes.

The results, presented as percent change of FXII protein level compared to the level of Factor XII protein on dosing day, are shown in FIG. 2 and demonstrate that the tested duplexes potently and durably inhibit Factor XII protein expression.

| week post dose | AD-67244 | | | | AD-1534528 | | | | AD-1534582 | | | |
|---|---|---|---|---|---|---|---|---|---|---|---|---|
| | 1 | 2 | 3 | 4 | 1 | 2 | 3 | 4 | 1 | 2 | 3 | 4 |
| 0 | 100 | 100 | 100 | 100 | 100 | 100 | 100 | 100 | 100 | 100 | 100 | 100 |
| 1 | 65.34895 | 20.50654 | 17.29683 | 27.21547 | 11.64461 | 3.554502 | 10.1083 | 14.98929 | 6.960784 | 7.714844 | 5.288673 | 9.657948 |
| 2 | 47.48658 | 15.84967 | 14.64581 | 14.79982 | 10.69943 | 8.395396 | 11.2515 | 12.95503 | 7.303922 | 5.615234 | 4.936095 | 7.243461 |
| 3 | 56.56418 | 21.07843 | 29.42199 | 21.1426 | 9.754253 | 7.989167 | 15.94465 | 15.63169 | 8.529412 | 8.886719 | 5.773468 | 7.696177 |
| 4 | 51.73255 | 39.29739 | 35.54976 | 28.78992 | 10.88847 | 13.30399 | 17.38869 | 21.19914 | 19.11765 | 19.33594 | 10.57735 | 14.78873 |
| 5 | 89.26305 | 56.0049 | 51.0213 | 45.56905 | 18.14745 | 56.93974 | 47.50301 | 45.61028 | 39.7549 | 37.64648 | 17.40855 | 29.67807 |
| 6 | 99.51196 | 67.81046 | 78.92221 | 77.10301 | 26.61626 | 24.64455 | 41.06498 | 44.48608 | 54.5098 | 63.08594 | 37.85809 | 45.57344 |

| week post | AD-1534611 | | | | AD-1534479 | | | | AD-1534506 | | | |
|---|---|---|---|---|---|---|---|---|---|---|---|---|
| dose | 1 | 2 | 3 | 4 | 1 | 2 | 3 | 4 | 1 | 2 | 3 | 4 |
| 0 | 100 | 100 | 100 | 100 | 100 | 100 | 100 | 100 | 100 | 100 | 100 | 100 |
| 1 | 6.979543 | 7.963937 | 11.20084 | 18.43778 | 6.711409 | 18.90204 | 8.954584 | 12.01629 | 29.11985 | 45.15939 | 37.0155 | 27.28698 |
| 2 | 7.380666 | 8.226897 | 13.58848 | 17.93824 | 4.32047 | 19.00066 | 5.869752 | 8.044807 | 27.99625 | 52.89256 | 31.87984 | 35.18035 |
| 3 | 9.466506 | 11.26972 | 15.66011 | 27.65668 | 5.411074 | 14.49704 | 8.997429 | 11.0998 | 42.69663 | 63.10508 | 52.13178 | 62.25823 |
| 4 | 18.21099 | 21.93839 | 30.58287 | 47.00273 | 7.214765 | 14.2998 | 11.39674 | 13.30618 | 60.44007 | 87.7804 | 78.34302 | 99.94773 |
| 5 | 33.213 | 48.98573 | 74.92978 | 98.09264 | 12.41611 | 33.79356 | 19.66581 | 23.0482 | 107.912 | 159.3861 | 106.5891 | 134.2394 |
| 6 | 52.1059 | 68.67017 | 84.33989 | 97.32062 | 20.05034 | 29.91453 | 21.33676 | 29.9389 | 109.7846 | 174.144 | 109.5446 | 114.7412 |

| week post | AD-1631309 | | | | AD-1534471 | | | | AD-1534555 | | | |
|---|---|---|---|---|---|---|---|---|---|---|---|---|
| dose | 1 | 2 | 3 | 4 | 1 | 2 | 3 | 4 | 1 | 2 | 3 | 4 |
| 0 | 100 | 100 | 100 | 100 | 100 | 100 | 100 | 100 | 100 | 100 | 100 | 100 |
| 1 | 50.47089 | 60.5 | 49.63441 | 39.58333 | 12.29314 | 17.51859 | 11.31222 | 17.60363 | 41.53754 | 37.8902 | 32.23109 | 39.03743 |
| 2 | 63.69863 | 65.6 | 71.91398 | 40.14757 | 12.19858 | 25.23234 | 16.20732 | 14.99148 | 45.29201 | 36.84966 | 33.86545 | 34.46767 |
| 3 | 75.21404 | 91.9 | 84.34409 | 69.57465 | 13.38061 | 25.78996 | 16.90662 | 17.54685 | 54.64839 | 41.15536 | 41.27708 | 44.57948 |
| 4 | 100.7705 | 100 | 82.92473 | 79.60069 | 17.68322 | 36.01301 | 23.44714 | 24.41794 | 77.89035 | 60.24399 | 55.72026 | 70.92854 |
| 5 | 133.476 | 137.7 | 91.69892 | 120.8333 | 23.92435 | 23.9777 | 20.19745 | 26.17831 | 138.4982 | 96.77072 | 88.93957 | 124.0156 |
| 6 | 135.8733 | 141.3 | 95.87097 | 108.7674 | 31.15839 | 38.61524 | 26.0798 | 51.50483 | 142.789 | 90.70685 | 102.8886 | 126.1546 |

| week post | AD-1534678 | | | |
|---|---|---|---|---|
| dose | 1 | 2 | 3 | 4 |
| 0 | 100 | 100 | 100 | 100 |
| 1 | 44.48113 | 58.29255 | 32.05556 | 45.29486 |
| 2 | 43.06604 | 61.12017 | 34.05556 | 49.49812 |
| 3 | 47.0283 | 70.85372 | 49.88889 | 61.29235 |
| 4 | 67.59434 | 94.72539 | 69.38889 | 87.32748 |
| 5 | 105.8491 | 151.4954 | 122.3333 | 119.5734 |
| 6 | 125.9434 | 142.9581 | 139.3889 | 133.8143 |

EQUIVALENTS

Those skilled in the art will recognize, or be able to ascertain using no more than routine experimentation, many equivalents to the specific embodiments and methods described herein. Such equivalents are intended to be encompassed by the scope of the following claims.

SEQUENCE LISTING (1340 sequences)

SEQ ID NO: 1 - DNA, 2036 bp, Homo sapiens
  source 1..2036: mol_type = genomic DNA
actcctggataggcagctggaccaacggacggatgccatgagggctctgctgctcctggggttcctgctggtgagcttggagtcaacactttcgattccaccttgggaagcccccaaggagcataagtacaaagctgaagagcacacagtcgttctcactgtcaccggggagccctgccacttccccttccagtaccaccggcagctgtaccacaaatgtacccacaagggccggccaggccctcagccctggtgtgctaccacccccaactttgatcaggaccagcgatggggatactgtttggagcccaagaaagtgaaagaccactgcagcaaacacagcccctgccagaaaggagggacctgtgtgaacatgccaagcggcccccactgtctctgtccacaacacctcactggaaaccactgccagaaagagaagtgctttgagcctcagcttctccggtttttccacaagaatgagatatggtatagaactgagcaagcagctgtggccagatgccagtgcaagggtcctgatgcccactgccagcggctggccagccaggcctgccgcaccaacccgtgcctccatgggggtcgctgcctagaggtggagggccaccgcctgtgccactgcccggtgggctacaccggagccttctgcgacgtggacaccaaggcaagctgctatgatggccgcgggctcagctaccgcggcctggccaggaccacgctctcgggtgcgccctgtcagccgtgggcctcggaggccacctaccggaacgtgactgccgagcaagcgcggaactggggactgggcggccacgccttctgccggaacccggacaacgacatccgcccgtggtgcttcgtgctgaaccgcgaccggctgagctgggagtactgcgacctggcacagtgccagaccccaacccaggcggcgcctccgaccccggtgtcccctaggcttcatgtcccactcatgcccgcgcagccggcaccgccgaagcctcagcccacgacccggaccccgcctcagtcccagaccccgggagccttgccggcgaagcgggagcagccgccttccctgaccaggaacggcccactgagctgcgggcagcggctccgcaagagtctgtcttcgatgacccgcgtcgttggcgggctggtggcgctacgcggggcgcacccctacatcgccgcgctgtactggggccacagtttctgcgccggcagcctcatcgccccctgctgggtgctgacggccgctcactgcctgcaggaccggcccgcacccgaggatctgacggtggtgctcggccaggaacgccgtaaccacagctgtgagccgtgccagacgttggccgtgcgctcctaccgcttgcacgaggccttctcgcccgtcagctaccagcacgacctggctctgttgcgccttcaggaggatgcggacggcagctgcgcgctcctgtcgccttacgttcagccggtgtgcctgccaagcggcgccgcgcgaccctccgagaccacgctctgccaggtggccggctggggccaccagttcgagggggcggaggaatatgccagcttcctgcaggaggcgcaggtaccgttcctctccctggagcgctgctcagccccggacgtgcacggatcctccatcctccccggcatgctctgcgcagggttcctcgagggcggcaccgatgcgtgccagggtgattccggaggcccgctggtgtgtgaggaccaagctgcagagcgccggctcaccctgcaaggcatcatcagctggggatcgggctgtggtgaccgcaacaagccaggcgtctacaccgatgtggcctactacctggcctggatccgggagcacaccgtttcctgattgctcagggactcatctttccctccttggtgattccgcagtgagagagtggctggggcatggaaggcaagattgtgtcccattcccccagtgcggccagctccgcgccaggatggcgcaggaactcaataaagtgctttgaaaatgctga

SEQ ID NO: 2 - DNA, 2036 bp, Homo sapiens
  source 1..2036: mol_type = genomic DNA
tcagcattttcaaagcactttattgagttcctgcgccatcctggcgcggagctggccgcactgggggaatgggacacaatcttgccttccatgccccagccactctctcactgcggaatcaccaaggagggaaagatgagtccctgagcaatcaggaaacggtgtgctcccggatccaggccaggtagtaggccacatcggtgtagacgcctggcttgttgcggtcaccacagcccgatccccagctgatgatgccttgcagggtgagccggcgctctgcagcttggtcctcacacaccagcgggcctccggaatcaccctggcacgcatcggtgccgccctcgaggaaccctgcgcagagcatgccggggaggatggaggatccgtgcacgtccggggctgagcagcgctccagggagaggaacggtacctgcgcctcctgcaggaagctggcatattcctccgccccctcgaactggtggccccagccggccacctggcagagcgtggtctcggagggtcgcgcggcgccgcttggcaggcacaccggctgaacgtaaggcgacaggagcgcgcagctgccgtccgcatcctcctgaaggcgcaacagagccaggtcgtgctggtagctgacgggcgagaaggcctcgtgcaagcggtaggagcgcacggccaacgtctggcacggctcacagctgtggttacggcgttcctggccgagcaccaccgtcagatcctcgggtgcgggccggtcctgcaggcagtgagcggccgtcagcacccagcagggggcgatgaggctgccggcgcagaaactgtggccccagtacagcgcggcgatgtaggggtgcgccccgcgtagcgccaccagcccgccaacgacgcgggtcatcgaagacagactcttgcggagccgctgcccgcagctcagtgggccgttcctggtcagggaaggcggctgctcccgcttcgccggcaaggctcccggggtctgggactgaggcggggtccgggtcgtgggctgaggcttcggcggtgccggctgcgcgggcatgagtgggacatgaagcctaggggacaccggggtcggaggcgccgcctgggttggggtctggcactgtgccaggtcgcagtactcccagctcagccggtcgcggttcagcacgaagcaccacgggcggatgtcgttgtccgggttccggcagaaggcgtggccgcccagtccccagttccgcgcttgctcggcagtcacgttccggtaggtggcctccgaggcccacggctgacagggcgcacccgagagcgtggtcctggccaggccgcggtagctgagcccgcggccatcatagcagcttgccttggtgtccacgtcgcagaaggctccggtgtagcccaccgggcagtggcacaggcggtggccctccacctctaggcagcgacccccatggaggcacgggttggtgcggcaggcctggctggccagccgctggcagtgggcatcaggacccttgcactggcatctggccacagctgcttgctcagttctataccatatctcattcttgtggaaaaaccggagaagctgaggctcaaagcacttctctttctggcagtggtttccagtgaggtgttgtggacagagacagtgggggccgcttggcatgttcacacaggtccctcctttctggcaggggctgtgtttgctgcagtggtctttcactttcttgggctccaaacagtatccccatcgctggtcctgatcaaagttgggggtggtagcacaccagggctgagggcctggccggcccttgtgggtacatttgtggtacagctgccggtggtactggaaggggaagtggcagggctccccggtgacagtgagaacgactgtgtgctcttcagctttgtacttatgctccttgggggcttcccaaggtggaatcgaaagtgttgactccaagctcaccagcaggaaccccaggagcagcagagccctcatggcatccgtccgttggtccagctgcctatccaggagt

SEQ ID NO: 3 - DNA, 1971 bp, Mus musculus
  source 1..1971: mol_type = genomic DNA
actcctgggcaggcagcggggccatcggcagacgccatgacggctctgttgttcctggggtctctgctgatgagtctggatctgacactttcggctccaccatggaaagactccaagaaatttaaggacgcacctgatgggcccacagtggttctcactgtggatgggaggctctgccattttccctttcagtaccaccgtcagctacaccacaaatgcatccacaaaaggcggccaggctcccgcccctggtgtgctaccacccccaactttgatgaagatcagcaatggggatactgcttggagcccaagaaagtgaaagaccattgcagcaaacacaacccgtgccacaaaggagggacatgtatcaacacccccaatgggccacactgtctctgccctgaacacctcactgggaaacattgccagaaagagaaatgctttgagcctcagcttctcaagttcttccacgagaatgagctatggtttagaacggggccaggaggtgtggccaggtgcgagtgcaaaggttctgaggctcactgcaagccggtggccagccaggcctgcagcatcaatccgtgccttaatgggggcagctgcctcctcgtggaggaccacccactgtgccgttgccctacaggctacactggatatttttgcgacttggacctttgggcgacctgctatgaaggcagggggctcagctaccggggccaggctggaactacgcaatcgggtgcgccatgtcagcggtggaccgtggaggccacctaccggaacatgactgagaagcaagcgctaagctggggcctgggccaccacgcattttgccggaacccagataatgacacacgtccatggtgcttcgtctggagtggcgacaggctgagctgggactattgcggcctggagcagtgccagacgccaacgtttgcacctctagttgtccctgagagtcaggaggagtccccgtcccaggcaccatctctgtcccatgcaccaaatgactcgaccgatcatcagacttctctgtccaagaccaacacgatgggctgcggacagaggttccgcaagggactgtcctcgttcatgcgcgtggtgggcggactagtggctctgcctgggtcgcacccctacatcgctgcactgtactggggtaacaacttctgcgcgggcagtctcatcgccccctgttgggtgctgaccgcggctcactgcctgcagaatcggccagcgcccgaggaactgacagtggtacttggtcaagatcgccacaaccagagctgcgagtggtgccagactctggctgtgcgctcctaccgccttcacgagggcttctcctccatcacctaccagcacgacttggctctgctgcgcctgcaggaaagcaaaaccaacagttgcgcgatcctgtcacctcacgttcagcctgtgtgtctacccagcggcgcggccccaccctctgagacagtgctctgcgaggtggccggctggggtcaccagttcgagggggctgaagaatactccaccttcctgcaggaggcacaggttccctttatcgccctggatcgctgctccaactctaacgtgcacggagacgccattctccctgggatgctttgcgctggcttcttggagggaggcaccgatgcctgccagggtgactccgggggccctctggtgtgtgaggaaggaactgcagaacatcagctcaccctgcgcggagtcatcagctggggctccggctgtggtgaccgcaacaagcccggagtctacacagacgtggccaactacctggcttggatccagaagcatattgcttcataactaaccaggctttatccttccctccttgtgtgctccttgggatgggacgatgaatgtggcatgctgggtcacagtgaagctagtgccccgacactgggggcacagaaactcaataaagtgctttgaaaacgttcctcagaa

SEQ ID NO: 4 - DNA, 1971 bp, Mus musculus
  source 1..1971: mol_type = genomic DNA
ttctgaggaacgttttcaaagcactttattgagtttctgtgcccccagtgtcggggcactagcttcactgtgacccagcatgccacattcatcgtcccatcccaaggagcacacaaggagggaaggataaagcctggttagttatgaagcaatatgcttctggatccaagccaggtagttggccacgtctgtgtagactccgggcttgttgcggtcaccacagccggagccccagctgatgactccgcgcagggtgagctgatgttctgcagttccttcctcacacaccagagggcccccggagtcaccctggcaggcatcggtgcctccctccaagaagccagcgcaaagcatcccagggagaatggcgtctccgtgcacgttagagttggagcagcgatccagggcgataaagggaacctgtgcctcctgcaggaaggtggagtattcttcagccccctcgaactggtgaccccagccggccacctcgcagagcactgtctcagagggtggggccgcgccgctgggtagacacacaggctgaacgtgaggtgacaggatcgcgcaactgttggttttgctttcctgcaggcgcagcagagccaagtcgtgctggtaggtgatggaggagaagccctcgtgaaggcggtaggagcgcacagccagagtctggcaccactcgcagctctggttgtggcgatcttgaccaagtaccactgtcagttcctcgggcgctggccgattctgcaggcagtgagccgcggtcagcacccaacagggggcgatgagactgcccgcgcagaagttgttaccccagtacagtgcagcgatgtaggggtgcgacccaggcagagccactagtccgcccaccacgcgcatgaacgaggacagtcccttgcggaacctctgtccgcagcccatcgtgttggtcttggacagagaagtctgatgatcggtcgagtcatttggtgcatgggacagagatggtgcctgggacggggactcctcctgactctcagggacaactagaggtgcaaacgttggcgtctggcactgctccaggccgcaatagtcccagctcagcctgtcgccactccagacgaagcaccatggacgtgtgtcattatctgggttccggcaaaatgcgtggtggcccaggccccagcttagcgcttgcttctcagtcatgttccggtaggtggcctccacggtccaccgctgacatggcgcacccgattgcgtagttccagcctggccccggtagctgagccccctgccttcatagcaggtcgcccaaaggtccaagtcgcaaaaatatccagtgtagcctgtagggcaacggcacagtgggtggtcctccacgaggaggcagctgcccccattaaggcacggattgatgctgcaggcctggctggccaccggcttgcagtgagcctcagaacctttgcactcgcacctggccacacctcctggccccgttctaaaccatagctcattctcgtggaagaacttgagaagctgaggctcaaagcatttctctttctggcaatgtttcccagtgaggtgttcagggcagagacagtgtggcccattgggggtgttgatacatgtccctcctttgtggcacgggttgtgtttgctgcaatggtctttcactttcttgggctccaagcagtatccccattgctgatcttcatcaaagttgggggtggtagcacaccaggggcgggagcctggccgccttttgtggatgcatttgtggtgtagctgacggtggtactgaaagggaaaatggcagagcctcccatccacagtgagaaccactgtgggcccatcaggtgcgtccttaaatttcttggagtctttccatggtggagccgaaagtgtcagatccagactcatcagcagagaccccaggaacaacagagccgtcatggcgtctgccgatggccccgctgcctgcccaggagt

SEQ ID NO: 5 - DNA, 2128 bp, Rattus norvegicus
  source 1..2128: mol_type = genomic DNA
caggaacccatctcggtactctgcttccaccagccttgccctgctcacgagggttcgacggcgctgttcttctgggctttctgtgaagtctgtgctcctcaggcccaggagggagcttaaccaatctccacctctgaggtttctgagacctttgcccacatctattgatccttactctggggcaggcagctgggccattggcggacgccatgacggctctgttgttcctggggtctctgctgatgagtctggacttgacactttcggcgccaccgtggaagtccaaggagttcaaggacggagctggcgatccctctgtggttctcactgtggacgggaagctctgccactttccctttcagtaccaccgtcgcctgtaccacaaatgcatccacaaaggacagccaggctccaggccctggtgtgctaccacccccaactttgacgaggaccagcaatggggatactgcttggagcccaagaaagtgaaagaccattgcagcaaacacagcccctgccacaaaggagggacgtgtgtcaacacccccaacggcccgcactgtctctgccctgaacacctcaccgggaaacattgccagagagagaaatgctttgagtctcagctcctcaagttcttccatgagaatgagatatggtttagaactgggccaggaggtgtggccaggtgccagtgcaaaggtcctcaggctgtttgcaagctgctgaccagtcaggtttgcagggtcaatccgtgccttaatggaggcacctgcctcctcgtggaggaccaccgactgtgccactgccctgcaggctatgccggacctttttgcgacttagaccttaaggcgacttgctacgaagacaggggtctcagctaccggggccaggctaaaactactctgtcgggtgcaccatgtcagcggtgggcctcggaggccacctaccggaacatgactgagacgcaagctctaagctggggcctgggccaccacgcattctgccggaacccagataatgacacacgtccatggtgctacgtctggagtggcgacaggctgagctgggactactgcgacctggaacagtgccagatgccaacgctcacatctccggtttcccctgagagtcacgacatgctgaagccccggcctcccatattgcagatgcctcagttcccgtctctgtccgatgcactagacaactcgacccgtaatcagaatgttgtgtccaggaccagtacggtggtctgcggacagaggtttcgcaagcgactgtcctcgctcaggcgcgtggtgggcggactagtggctctgcctggatcgcatccctacatcgctgcactgtactggggcgacagcttctgcgcaggcagtctcatcgacccctgctgggtgctgaccgctgctcactgcttgcagaaacggccagcgcccgaggaactgacagtggtacttggtcaagatcgccataaccagagctgcgagaggtgccagactctggctgtgcactcctaccgccttcacgagggcttctcttccaaaacctaccagcatgatttggctctgctgcgcctgcgggggaggaaaaacagctgcgcgatcttgtcgcctcatgtccagccggtgtgtctgcccagcagcgcggccccaccctctgagacagtgctctgcgaggtggccggctggggtcatcagttcgagggggctgaagaatacgccacctttctgcaggaggcacaggtacccttcatctccctggatcgctgctccagctctaacgtgcacggagacgccatcctgcctgggatgctttgtgctggcttcttggagggaggcgccgatgcctgtcagggtgactccgggggtcctctggtatgtgatgaaggagttacagagcgtcagctcaccctgcgaggagtcatcagctggggctccggctgtggtgaccggaacaagcccggggtctacactgacgtggccaattacctggattggatccaggagcatactgctttctaagtaaccagggtcggtccttgcgaagctagtggctgggccccagggacacagaaactcaataaagtgctttgaaaacgttaaaaaaaaaaaaaaaaaaaaaaaaaaaa

SEQ ID NO: 6 - DNA, 2128 bp, Rattus norvegicus
  source 1..2128: mol_type = genomic DNA
ttttttttttttttttttttttttttttaacgttttcaaagcactttattgagtttctgtgtccctggggcccagccactagcttcgcaaggaccgaccctggttacttagaaagcagtatgctcctggatccaatccaggtaattggccacgtcagtgtagaccccgggcttgttccggtcaccacagccggagccccagctgatgactcctcgcagggtgagctgacgctctgtaactccttcatcacataccagaggacccccggagtcaccctgacaggcatcggcgcctccctccaagaagccagcacaaagcatcccaggcaggatggcgtctccgtgcacgttagagctggagcagcgatccagggagatgaagggtacctgtgcctcctgcagaaaggtggcgtattcttcagccccctcgaactgatgaccccagccggccacctcgcagagcactgtctcagagggtggggccgcgctgctgggcagacacaccggctggacatgaggcgacaagatcgcgcagctgtttttcctcccccgcaggcgcagcagagccaaatcatgctggtaggttttggaagagaagccctcgtgaaggcggtaggagtgcacagccagagtctggcacctctcgcagctctggttatggcgatcttgaccaagtaccactgtcagttcctcgggcgctggccgtttctgcaagcagtgagcagcggtcagcacccagcaggggtcgatgagactgcctgcgcagaagctgtcgccccagtacagtgcagcgatgtagggatgcgatccaggcagagccactagtccgcccaccacgcgcctgagcgaggacagtcgcttgcgaaacctctgtccgcagaccaccgtactggtcctggacacaacattctgattacgggtcgagttgtctagtgcatcggacagagacgggaactgaggcatctgcaatatgggaggccggggcttcagcatgtcgtgactctcaggggaaaccggagatgtgagcgttggcatctggcactgttccaggtcgcagtagtcccagctcagcctgtcgccactccagacgtagcaccatggacgtgtgtcattatctgggttccggcagaatgcgtggtggcccaggccccagcttagagcttgcgtctcagtcatgttccggtaggtggcctccgaggcccaccgctgacatggtgcacccgacagagtagttttagcctggccccggtagctgagacccctgtcttcgtagcaagtcgccttaaggtctaagtcgcaaaaaggtccggcatagcctgcagggcagtggcacagtcggtggtcctccacgaggaggcaggtgcctccattaaggcacggattgaccctgcaaacctgactggtcagcagcttgcaaacagcctgaggacctttgcactggcacctggccacacctcctggcccagttctaaaccatatctcattctcatggaagaacttgaggagctgagactcaaagcatttctctctctggcaatgtttcccggtgaggtgttcagggcagagacagtgcgggccgttgggggtgttgacacacgtccctcctttgtggcaggggctgtgtttgctgcaatggtctttcactttcttgggctccaagcagtatccccattgctggtcctcgtcaaagttgggggtggtagcacaccagggcctggagcctggctgtcctttgtggatgcatttgtggtacaggcgacggtggtactgaaagggaaagtggcagagcttcccgtccacagtgagaaccacagagggatcgccagctccgtccttgaactccttggacttccacggtggcgccgaaagtgtcaagtccagactcatcagcagagaccccaggaacaacagagccgtcatggcgtccgccaatggcccagctgcctgccccagagtaaggatcaatagatgtgggcaaaggtctcagaaacctcagaggtggagattggttaagctccctcctgggcctgaggagcacagacttcacagaaagcccagaagaacagcgccgtcgaaccctcgtgagcagggcaaggctggtggaagcagagtaccgagatgggttcctg

SEQ ID NO: 7 - DNA, 2420 bp, Macaca fascicularis
  source 1..2420: mol_type = genomic DNA
atgggcattgttgtaagctgctgagtttatggcaatttgttacatgacaatagaaaacgaacacacttcgcagtggactccaagatgcccgtgaaagggagcttctctttgatctccttaacctcctcatctccacaggacccagagcacaagaacgtcccttctcctgcttctagtcccaccgtctagaaaagagaggaggagcccagctcttcatcattccacccccacccactaactcccaacttcctggccctcagcgggtgaccaaggaagtcagtccacttggctttccataaacagcctgtgccccaccaggctcaggggggcagcttgaccaatccctatttccaagacctttggccaaccctattgatctggactcctgggcagacagttggaccaacggacagacgccatgagggctctgctgctcatggggttcctgctggtgagcctggagtcaacactttcgattccaccttggaaagcgcccaaggagcataagtacaaagctgaagagcacacagtcgttctcactgtcaccggggagccctgccacttccccttccagtaccaccggcggctgtaccacaaatgtacccacaagggccggccaggccctcagacctggtgtgctaccacccctaactttgatgaggaccagcgctggggatactgtgtggagcccaagaaagtgaaagaccactgcagtaaacacagcccctgccagaaaggggggacctgtgtgaacacgctgagtggcacccactgtctctgtccacaacacctcactgggaaccactgccagagagagaagtgctttgagcctcagcttctccggtttttccacgagaatgagatatggtatagatctgagcaagcagctgtggccagatgccagtgcaagggtcctgatgcccactgccagcggctggccagccaggcctgccgcaccaacccgtgcctccatgggggtcgctgcctagaggtggagggccaccgcctgtgccactgccccgtgggctacaccggacccttctgcgacttggacaccaaggcgagctgctatgatggccgcgggctcagctaccgcggcctggccaggaccacgctctcgggtgcgccctgtcagccgtggacctcggaggccacctactggaacgtgacggccgagcaagcgcggaactggggactgggcggccacgccttctgccggaacccggacaacgacatccgcccgtggtgcttcgtgctgatcggcgacaggctaagctgggagtactgcgacgtggcacagtgccaggccccaacccaggcggcgcctccgacgccggtgtcccctgggcttcatgtcccactcatgcccccgcagccggcaccgccgaagcttcagcccacgacccggaccccgcctcagtcccagaccccgggagccttgccagtgaagcgggagcagccgcctcgcctgacccggaacggctcagtgagctgcgggcagcggctccgcaagagtctgtcttcgatgacccgcgtcgttggcgggctggtggcgctacgcggggcgcacccctacatcgccgcgctgtactggggccacagtttctgcgccggcagcctcatcgccccctgctgggtgctgacggccgctcactgcctgcaggaccggccggcacccgaggatctgacggtagtactcggccaggaacgccataaccacagctgtgaacagtgccagactctggccgtgcgctcctaccgcttgcacgaggccttctcgcccgacagctaccagcacgacctggctctgttgcgccttcaggaggatgcggacggcagctgcgcgctcctgtcgccttacgttcagccggtgtgcctgccaagcggcgccgcgcgaccctccgagcccgcgctctgccaggtggctggctggggccaccagttcgagggggcggaggaatattccagcttcctgcaggaggcgcaggtacccttcctctccctggagagctgctcagcaccggaggtgcacggagcctccatcctccccggcatgctctgcgcagggttcctcgagggcggcaccgatgcatgccagggtgattccggaggcccgctggtgtgtgaggaccaagccgcagagcgccggctcaccctgcaaggcatcatcagctggggatcgggctgtggtgaccgcaacaagccaggcgtctacaccgatgtggcctactacctggcctggatccgggagcacaccgcttcctgattgctcagggactcatctttccctcctcggtgattccgcagtgggagactggctggggcatggaaggcaaaattgtgtcccattcccccaatgcggccagctccgcgccaggatggcgcaggaactcaataaagtgctttgaaaatgctgagaa

SEQ ID NO: 8 - DNA, 2420 bp, Macaca fascicularis
  source 1..2420: mol_type = genomic DNA
ttctcagcattttcaaagcactttattgagttcctgcgccatcctggcgcggagctggccgcattgggggaatgggacacaattttgccttccatgccccagccagtctcccactgcggaatcaccgaggagggaaagatgagtccctgagcaatcaggaagcggtgtgctcccggatccaggccaggtagtaggccacatcggtgtagacgcctggcttgttgcggtcaccacagcccgatccccagctgatgatgccttgcagggtgagccggcgctctgcggcttggtcctcacacaccagcgggcctccggaatcaccctggcatgcatcggtgccgccctcgaggaaccctgcgcagagcatgccggggaggatggaggctccgtgcacctccggtgctgagcagctctccagggagaggaagggtacctgcgcctcctgcaggaagctggaatattcctccgccccctcgaactggtggccccagccagccacctggcagagcgcgggctcggagggtcgcgcggcgccgcttggcaggcacaccggctgaacgtaaggcgacaggagcgcgcagctgccgtccgcatcctcctgaaggcgcaacagagccaggtcgtgctggtagctgtcgggcgagaaggcctcgtgcaagcggtaggagcgcacggccagagtctggcactgttcacagctgtggttatggcgttcctggccgagtactaccgtcagatcctcgggtgccggccggtcctgcaggcagtgagcggccgtcagcacccagcagggggcgatgaggctgccggcgcagaaactgtggccccagtacagcgcggcgatgtaggggtgcgccccgcgtagcgccaccagcccgccaacgacgcgggtcatcgaagacagactcttgcggagccgctgcccgcagctcactgagccgttccgggtcaggcgaggcggctgctcccgcttcactggcaaggctcccggggtctgggactgaggcggggtccgggtcgtgggctgaagcttcggcggtgccggctgcgggggcatgagtgggacatgaagcccaggggacaccggcgtcggaggcgccgcctgggttggggcctggcactgtgccacgtcgcagtactcccagcttagcctgtcgccgatcagcacgaagcaccacgggcggatgtcgttgtccgggttccggcagaaggcgtggccgcccagtccccagttccgcgcttgctcggccgtcacgttccagtaggtggcctccgaggtccacggctgacagggcgcacccgagagcgtggtcctggccaggccgcggtagctgagcccgcggccatcatagcagctcgccttggtgtccaagtcgcagaagggtccggtgtagcccacggggcagtggcacaggcggtggccctccacctctaggcagcgacccccatggaggcacgggttggtgcggcaggcctggctggccagccgctggcagtgggcatcaggacccttgcactggcatctggccacagctgcttgctcagatctataccatatctcattctcgtggaaaaaccggagaagctgaggctcaaagcacttctctctctggcagtggttcccagtgaggtgttgtggacagagacagtgggtgccactcagcgtgttcacacaggtcccccctttctggcaggggctgtgtttactgcagtggtctttcactttcttgggctccacacagtatccccagcgctggtcctcatcaaagttaggggtggtagcacaccaggtctgagggcctggccggcccttgtgggtacatttgtggtacagccgccggtggtactggaaggggaagtggcagggctccccggtgacagtgagaacgactgtgtgctcttcagctttgtacttatgctccttgggcgctttccaaggtggaatcgaaagtgttgactccaggctcaccagcaggaaccccatgagcagcagagccctcatggcgtctgtccgttggtccaactgtctgcccaggagtccagatcaatagggttggccaaaggtcttggaaatagggattggtcaagctgcccccctgagcctggtggggcacaggctgtttatggaaagccaagtggactgacttccttggtcacccgctgagggccaggaagttgggagttagtgggtgggggtggaatgatgaagagctgggctcctcctctcttttctagacggtgggactagaagcaggagaagggacgttcttgtgctctgggtcctgtggagatgaggaggttaaggagatcaaagagaagctccctttcacgggcatcttggagtccactgcgaagtgtgttcgttttctattgtcatgtaacaaattgccataaactcagcagcttacaacaatgcccat

SEQ ID NO: 9 - DNA, 2079 bp, Macaca mulatta
  source 1..2079: mol_type = genomic DNA
attccaccttggaaagcgcccaaggagcataagtacaaagctgaagagcacacagtcgtatgtctcgtgggcatgaatcataccacacagaggccaggaccttcaatgggcaaggaaggatcaagagctggtctctggcattcgaatgcctctgaatcccagctttatcacttatgagctgggtgactctggttctcactgtcaccggggagccctgccacttccccttccagtaccaccggcggctgtaccacaaatgtacccacaagggccggccaggccctcagacctggtgtgctaccacccctaactttgatgaggaccagcgatggggatactgtgtggagcccaagaaagtgaaagaccactgcagtaaacacagcccctgccagaaaggggggacctgtgtgaacacgctgagtggcacccactgtctctgtccacaacacctcactgggaaccactgccagagagagaagtgctttgagcctcagcttctccggtttttccacgagaatgagatatggtatagatctgagcaagcagctgtggccagatgccagtgcaagggtcctgatgcccactgccagcggctggccagccaggcctgccgcaccaacccgtgcctccatgggggtcgctgcctagaggtggagggccaccgcctgtgccactgccccgtgggctacaccggacccttctgcgacttggacaccaaggcgagctgctatgatggccgcgggctcagctaccgcggcctggccaggaccacgctctcgggtgcgccctgtcagccgtggacctcggaggccacctactggaacgtgacggccgagcaagcgcggaactggggactgggcggccacgccttctgccggaacccggacaacgacatccgcccgtggtgcttcgtgctgatcggcgacaggctaagctgggagtactgcgacgtggcacagtgccaggccccaacccaggcggcgcctccgacgccggtgtcccctgggcttcatgtcccactcatgcccccgcagccggcaccgccgaagcttcagcccacgacccggaccccgcctcagtcccagaccccgggagccttgccagtgaagcaggagcagccgcctcgcctgacccggaacggctcagtgagctgcgggcagcggctccgcaagagtctgtcttcgatgacccgcgtcgttggcgggctggtggcgctacgcggggcgcacccctacatcgccgcgctgtactggggccacagtttctgcgccggcagcctcatcgccccctgctgggtgctgacggccgcccactgcctgcaggaccggccggcacccgaggatctgacggtagtactcggccaggaacgccataaccacagctgtgaacagtgccagactctggccgtgcgctcctaccgcttgcacgaggccttctcgcccgacagctaccagcacgacctggctctgttgcgccttcaggaggatgcggacggcagctgcgcgctcctgtcgccttacgttcagccggtgtgcctgccaagcggcgccgcgcgaccctccgagcccgcgctctgccaggtggctggctggggccaccagttcgagggggcggaggaatattccagcttcctgcaggaggcgcaggtacccttcctctccctggagagctgctcagcaccggaggtgcacggagcttccatcctccccggcatgctctgcgcagggttcctcgagggcggcaccgatgcatgccagggtgattccggaggcccgctggtgtgtgaggaccaagccgcagagcgccggctcaccctgcaaggcatcatcagctggggatcgggctgtggtgaccgcaacaagccaggcgtctacaccgatgtggcctactacctggcctggatccgggagcacaccgcttcctgattgctcagggactcatctttccctcctcggtgattccgcagtgggagactggctggggcatggaaggcaaaattgtgtcccattcccccaatgcggccagctccgcgccaggatggcgcaggaactcaataaagtgctttgaaaatgctgagaa

SEQ ID NO: 10 - DNA, 2079 bp, Macaca mulatta
  source 1..2079: mol_type = genomic DNA
ttctcagcattttcaaagcactttattgagttcctgcgccatcctggcgcggagctggccgcattgggggaatgggacacaattttgccttccatgccccagccagtctcccactgcggaatcaccgaggagggaaagatgagtccctgagcaatcaggaagcggtgtgctcccggatccaggccaggtagtaggccacatcggtgtagacgcctggcttgttgcggtcaccacagcccgatccccagctgatgatgccttgcagggtgagccggcgctctgcggcttggtcctcacacaccagcgggcctccggaatcaccctggcatgcatcggtgccgccctcgaggaaccctgcgcagagcatgccggggaggatggaagctccgtgcacctccggtgctgagcagctctccagggagaggaagggtacctgcgcctcctgcaggaagctggaatattcctccgccccctcgaactggtggccccagccagccacctggcagagcgcgggctcggagggtcgcgcggcgccgcttggcaggcacaccggctgaacgtaaggcgacaggagcgcgcagctgccgtccgcatcctcctgaaggcgcaacagagccaggtcgtgctggtagctgtcgggcgagaaggcctcgtgcaagcggtaggagcgcacggccagagtctggcactgttcacagctgtggttatggcgttcctggccgagtactaccgtcagatcctcgggtgccggccggtcctgcaggcagtgggcggccgtcagcacccagcagggggcgatgaggctgccggcgcagaaactgtggccccagtacagcgcggcgatgtaggggtgcgccccgcgtagcgccaccagcccgccaacgacgcgggtcatcgaagacagactcttgcggagccgctgcccgcagctcactgagccgttccgggtcaggcgaggcggctgctcctgcttcactggcaaggctcccggggtctgggactgaggcggggtccgggtcgtgggctgaagcttcggcggtgccggctgcgggggcatgagtgggacatgaagcccaggggacaccggcgtcggaggcgccgcctgggttggggcctggcactgtgccacgtcgcagtactcccagcttagcctgtcgccgatcagcacgaagcaccacgggcggatgtcgttgtccgggttccggcagaaggcgtggccgcccagtccccagttccgcgcttgctcggccgtcacgttccagtaggtggcctccgaggtccacggctgacagggcgcacccgagagcgtggtcctggccaggccgcggtagctgagcccgcggccatcatagcagctcgccttggtgtccaagtcgcagaagggtccggtgtagcccacggggcagtggcacaggcggtggccctccacctctaggcagcgacccccatggaggcacgggttggtgcggcaggcctggctggccagccgctggcagtgggcatcaggacccttgcactggcatctggccacagctgcttgctcagatctataccatatctcattctcgtggaaaaaccggagaagctgaggctcaaagcacttctctctctggcagtggttcccagtgaggtgttgtggacagagacagtgggtgccactcagcgtgttcacacaggtcccccctttctggcaggggctgtgtttactgcagtggtctttcactttcttgggctccacacagtatccccatcgctggtcctcatcaaagttaggggtggtagcacaccaggtctgagggcctggccggcccttgtgggtacatttgtggtacagccgccggtggtactggaaggggaagtggcagggctccccggtgacagtgagaaccagagtcacccagctcataagtgataaagctgggattcagaggcattcgaatgccagagaccagctcttgatccttccttgcccattgaaggtcctggcctctgtgtggtatgattcatgcccacgagacatacgactgtgtgctcttcagctttgtacttatgctccttgggcgctttccaaggtggaat

SEQ ID NO: 11 - RNA, 21 nt, synthetic construct
  modified_base 20..21: mod_base = OTHER; note = thymine
  misc_feature 1..21: note = Synthetic
  modified_base 4: mod_base = OTHER; note = adenosine-3'-phosphate
  modified_base 6: mod_base = OTHER; note = guanosine-3'-phosphate
  modified_base 9: mod_base = OTHER; note = guanosine-3'-phosphate
  modified_base 10: mod_base = OTHER; note = Adenosine-3'-phosphate
  modified_base 11: mod_base = OTHER; note = guanosine-3'-phosphate
  modified_base 13: mod_base = OTHER; note = adenosine-3'-phosphate
  modified_base 18: mod_base = OTHER; note = guanosine-3'-phosphate
  modified_base 19: mod_base = OTHER; note = adenosine-3'-phosphate
  modified_base 20: mod_base = OTHER; note = 2`-deoxythimidine-3`-phosphorothioate
  modified_base 21: mod_base = OTHER; note = 2`-deoxythimidine -3`-phosphate
  source 1..21: mol_type = other RNA
cttacgctgagtacttcgatt

SEQ ID NO: 12 - RNA, 21 nt, synthetic construct
  modified_base 20..21: mod_base = OTHER; note = thymine
  misc_feature 1..21: note = Synthetic
  modified_base 1: mod_base = OTHER; note = Uridine-3'-phosphate
  modified_base 2: mod_base = OTHER; note = cytidine-3'-phosphate
  modified_base 3: mod_base = OTHER; note = guanosine-3'-phosphate
  modified_base 4: mod_base = OTHER; note = adenosine-3'-phosphate
  modified_base 5: mod_base = OTHER; note = adenosine-3'-phosphate
  modified_base 6: mod_base = OTHER; note = guanosine-3'-phosphate
  modified_base 8: mod_base = OTHER; note = adenosine-3'-phosphate
  modified_base 9: mod_base = OTHER; note = cytidine-3'-phosphate
  modified_base 10: mod_base = OTHER; note = uridine-3'-phosphate
  modified_base 12: mod_base = OTHER; note = adenosine-3'-phosphate
  modified_base 13: mod_base = OTHER; note = guanosine-3'-phosphate
  modified_base 14: mod_base = OTHER; note = cytidine-3'-phosphate
  modified_base 15: mod_base = OTHER; note = guanosine-3'-phosphate
  modified_base 17: mod_base = OTHER; note = Adenosine-3'-phosphate
  modified_base 18: mod_base = OTHER; note = Adenosine-3'-phosphate
  modified_base 19: mod_base = OTHER; note = guanosine-3'-phosphate
  modified_base 20: mod_base = OTHER; note = 2`-deoxythimidine-3`-phosphorothioate
  modified_base 21: mod_base = OTHER; note = 2`-deoxythimidine -3`-phosphate
  source 1..21: mol_type = other RNA
tcgaagtactcagcgtaagtt

SEQ ID NO: 13 - RNA, 21 nt, synthetic construct
  misc_feature 1..21: note = Synthetic
  source 1..21: mol_type = other RNA
aactcaataaagtgctttgaa

SEQ ID NO: 14 - protein, 16 aa, synthetic construct
  REGION 1..16: note = Synthetic
AAVALLPAVLLALLAP

SEQ ID NO: 15 - protein, 11 aa, synthetic construct
  REGION 1..11: note = Synthetic
AALLPVLLAAP

SEQ ID NO: 16 - protein, 13 aa, Human Immunodeficiency Virus
GRKKRRQRRRPPQ

SEQ ID NO: 17 - protein, 16 aa, Drosophila sp.
RQIKIWFQNRRMKWKK

SEQ ID NO: 18 - RNA, 23 nt, synthetic construct
  misc_feature 1..23: note = Synthetic
  source 1..23: mol_type = other RNA
ttcaaagcactttattgagtttc

SEQ ID NO: 19 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 7: mod_base = OTHER; note = 2'-fluoroadenosine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  source 1..21: mol_type = other RNA
aactcaataaagtgctttgaa

SEQ ID NO: 20 - RNA, 23 nt, synthetic construct
  misc_feature 1..23: note = Synthetic
  modified_base 1: mod_base = OTHER; note = 2'-O-methyluridine-3'-phosphorothioate
  modified_base 2: mod_base = OTHER; note = 2'-fluorouridine -3'-phosphorothioate
  modified_base 6: mod_base = OTHER; note = 2'-fluoroadenosine-3'-phosphate
  modified_base 8: mod_base = OTHER; note = 2'-fluorocytidine-3'-phosphate
  modified_base 9: mod_base = OTHER; note = 2'-fluoroadenosine-3'-phosphate
  modified_base 14: mod_base = OTHER; note = 2'-fluoroadenosine-3'-phosphate
  modified_base 16: mod_base = OTHER; note = 2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  source 1..23: mol_type = other RNA
ttcaaagcactttattgagtttc

SEQ ID NO: 21 - RNA, 21 nt, synthetic construct
  misc_feature 1..21: note = Synthetic
  source 1..21: mol_type = other RNA
aaagagaagtgctttgagcct

SEQ ID NO: 22 - RNA, 21 nt, synthetic construct
  misc_feature 1..21: note = Synthetic
  source 1..21: mol_type = other RNA
aaatgtacccacaagggccgt

SEQ ID NO: 23 - RNA, 21 nt, synthetic construct
  misc_feature 1..21: note = Synthetic
  source 1..21: mol_type = other RNA
aacccggacaacgacatccgt

SEQ ID NO: 24 - RNA, 21 nt, synthetic construct
  misc_feature 1..21: note = Synthetic
  source 1..21: mol_type = other RNA
aactcaataaagtgctttgat

SEQ ID NO: 25 - RNA, 21 nt, synthetic construct
  misc_feature 1..21: note = Synthetic
  source 1..21: mol_type = other RNA
aactgagcaagcagctgtggt

SEQ ID NO: 26 - RNA, 21 nt, synthetic construct
  misc_feature 1..21: note = Synthetic
  source 1..21: mol_type = other RNA
aagaatgagatatggtatagt

SEQ ID NO: 27 - RNA, 21 nt, synthetic construct
  misc_feature 1..21: note = Synthetic
  source 1..21: mol_type = other RNA
aagagcacacagtcgttctct

SEQ ID NO: 28 - RNA, 21 nt, synthetic construct
  misc_feature 1..21: note = Synthetic
  source 1..21: mol_type = other RNA
aagcagctgtggccagatgct

SEQ ID NO: 29 - RNA, 21 nt, synthetic construct
  misc_feature 1..21: note = Synthetic
  source 1..21: mol_type = other RNA
aagctgctatgatggccgcgt

SEQ ID NO: 30 - RNA, 21 nt, synthetic construct
  misc_feature 1..21: note = Synthetic
  source 1..21: mol_type = other RNA
aagtacaaagctgaagagcat

SEQ ID NO: 31 - RNA, 21 nt, synthetic construct
  misc_feature 1..21: note = Synthetic
  source 1..21: mol_type = other RNA
aagtgctttgagcctcagctt

SEQ ID NO: 32 - RNA, 21 nt, synthetic construct
  misc_feature 1..21: note = Synthetic
  source 1..21: mol_type = other RNA
aataaagtgctttgaaaatgt

SEQ ID NO: 33 - RNA, 21 nt, synthetic construct
  misc_feature 1..21: note = Synthetic
  source 1..21: mol_type = other RNA
acaaatgtacccacaagggct

SEQ ID NO: 34 - RNA, 21 nt, synthetic construct
  misc_feature 1..21: note = Synthetic
  source 1..21: mol_type = other RNA
acacagtcgttctcactgtct

SEQ ID NO: 35 - RNA, 21 nt, synthetic construct
  misc_feature 1..21: note = Synthetic
  source 1..21: mol_type = other RNA
acaccgatgtggcctactact

SEQ ID NO: 36 - RNA, 21 nt, synthetic construct
  misc_feature 1..21: note = Synthetic
  source 1..21: mol_type = other RNA
acactttcgattccaccttgt

SEQ ID NO: 37 - RNA, 21 nt, synthetic construct
  misc_feature 1..21: note = Synthetic
  source 1..21: mol_type = other RNA
acactttcgattccaccttgt

SEQ ID NO: 38 - RNA, 21 nt, synthetic construct
  misc_feature 1..21: note = Synthetic
  source 1..21: mol_type = other RNA
acagtcgttctcactgtcact

SEQ ID NO: 39 - RNA, 21 nt, synthetic construct
  misc_feature 1..21: note = Synthetic
  source 1..21: mol_type = other RNA
acatcgccgcgctgtactggt

SEQ ID NO: 40 - RNA, 21 nt, synthetic construct
  misc_feature 1..21: note = Synthetic
  source 1..21: mol_type = other RNA
accagcacgacctggctctgt

SEQ ID NO: 41 - RNA, 21 nt, synthetic construct
  misc_feature 1..21: note = Synthetic
  source 1..21: mol_type = other RNA
acccggacaacgacatccgct

SEQ ID NO: 42 - RNA, 21 nt, synthetic construct
  misc_feature 1..21: note = Synthetic
  source 1..21: mol_type = other RNA
accctgcaaggcatcatcagt

SEQ ID NO: 43 - RNA, 21 nt, synthetic construct
  misc_feature 1..21: note = Synthetic
  source 1..21: mol_type = other RNA
accgcaacaagccaggcgtct

SEQ ID NO: 44 - RNA, 21 nt, synthetic construct
  misc_feature 1..21: note = Synthetic
  source 1..21: mol_type = other RNA
acctggctctgttgcgccttt

SEQ ID NO: 45 - RNA, 21 nt, synthetic construct
  misc_feature 1..21: note = Synthetic
  source 1..21: mol_type = other RNA
acgttcagccggtgtgcctgt

SEQ ID NO: 46 - RNA, 21 nt, synthetic construct
  misc_feature 1..21: note = Synthetic
  source 1..21: mol_type = other RNA
actacctggcctggatccggt

SEQ ID NO: 47 - RNA, 21 nt, synthetic construct
  misc_feature 1..21: note = Synthetic
  source 1..21: mol_type = other RNA
actcaataaagtgctttgaat

SEQ ID NO: 48 - RNA, 21 nt, synthetic construct
  misc_feature 1..21: note = Synthetic
  source 1..21: mol_type = other RNA
actgagcaagcagctgtggct

SEQ ID NO: 49 - RNA, 21 nt, synthetic construct
  misc_feature 1..21: note = Synthetic
  source 1..21: mol_type = other RNA
agagaagtgctttgagcctct

SEQ ID NO: 50 - RNA, 21 nt, synthetic construct
  misc_feature 1..21: note = Synthetic
  source 1..21: mol_type = other RNA
agagcacacagtcgttctcat

SEQ ID NO: 51 - RNA, 21 nt, synthetic construct
  misc_feature 1..21: note = Synthetic
  source 1..21: mol_type = other RNA
agagtctgtcttcgatgacct

SEQ ID NO: 52 - RNA, 21 nt, synthetic construct
  misc_feature 1..21: note = Synthetic
  source 1..21: mol_type = other RNA
agatgccagtgcaagggtcct

SEQ ID NO: 53 - RNA, 21 nt, synthetic construct
  misc_feature 1..21: note = Synthetic
  source 1..21: mol_type = other RNA
agcacgacctggctctgttgt

SEQ ID NO: 54 - RNA, 21 nt, synthetic construct
  misc_feature 1..21: note = Synthetic
  source 1..21: mol_type = other RNA
agccaggcgtctacaccgatt

SEQ ID NO: 55 - RNA, 21 nt, synthetic construct
  misc_feature 1..21: note = Synthetic
  source 1..21: mol_type = other RNA
agccaggcgtctacaccgatt

SEQ ID NO: 56 - RNA, 21 nt, synthetic construct
  misc_feature 1..21: note = Synthetic
  source 1..21: mol_type = other RNA
agcccaagaaagtgaaagact

SEQ ID NO: 57 - RNA, 21 nt, synthetic construct
  misc_feature 1..21: note = Synthetic
  source 1..21: mol_type = other RNA
agctgaagagcacacagtcgt

SEQ ID NO: 58 - RNA, 21 nt, synthetic construct
  misc_feature 1..21: note = Synthetic
  source 1..21: mol_type = other RNA
agctgctatgatggccgcggt

SEQ ID NO: 59 - RNA, 21 nt, synthetic construct
  misc_feature 1..21: note = Synthetic
  source 1..21: mol_type = other RNA
agctgtaccacaaatgtacct

SEQ ID NO: 60 - RNA, 21 nt, synthetic construct
  misc_feature 1..21: note = Synthetic
  source 1..21: mol_type = other RNA
aggagcataagtacaaagctt

SEQ ID NO: 61 - RNA, 21 nt, synthetic construct
  misc_feature 1..21: note = Synthetic
  source 1..21: mol_type = other RNA
aggagcataagtacaaagctt

SEQ ID NO: 62 - RNA, 21 nt, synthetic construct
  misc_feature 1..21: note = Synthetic
  source 1..21: mol_type = other RNA
aggatggcgcaggaactcaat

SEQ ID NO: 63 - RNA, 21 nt, synthetic construct
  misc_feature 1..21: note = Synthetic
  source 1..21: mol_type = other RNA
aggcgtctacaccgatgtggt

SEQ ID NO: 64 - RNA, 21 nt, synthetic construct
  misc_feature 1..21: note = Synthetic
  source 1..21: mol_type = other RNA
aggcttcatgtcccactcatt

SEQ ID NO: 65 - RNA, 21 nt, synthetic construct
  misc_feature 1..21: note = Synthetic
  source 1..21: mol_type = other RNA
agtcaacactttcgattccat

SEQ ID NO: 66 - RNA, 21 nt, synthetic construct
  misc_feature 1..21: note = Synthetic
  source 1..21: mol_type = other RNA
agtcaacactttcgattccat

SEQ ID NO: 67 - RNA, 21 nt, synthetic construct
  misc_feature 1..21: note = Synthetic
  source 1..21: mol_type = other RNA
ataaagtgctttgaaaatgct

SEQ ID NO: 68 - RNA, 21 nt, synthetic construct
  misc_feature 1..21: note = Synthetic
  source 1..21: mol_type = other RNA
atccgcccgtggtgcttcgtt

SEQ ID NO: 69 - RNA, 21 nt, synthetic construct
  misc_feature 1..21: note = Synthetic
  source 1..21: mol_type = other RNA
atcgggctgtggtgaccgcat

SEQ ID NO: 70 - RNA, 21 nt, synthetic construct
  misc_feature 1..21: note = Synthetic
  source 1..21: mol_type = other RNA
atgccagtgcaagggtcctgt

SEQ ID NO: 71 - RNA, 21 nt, synthetic construct
  misc_feature 1..21: note = Synthetic
  source 1..21: mol_type = other RNA
atgctctgcgcagggttcctt

SEQ ID NO: 72 - RNA, 21 nt, synthetic construct
  misc_feature 1..21: note = Synthetic
  source 1..21: mol_type = other RNA
atgtacccacaagggccggct

SEQ ID NO: 73 - RNA, 21 nt, synthetic construct
  misc_feature 1..21: note = Synthetic
  source 1..21: mol_type = other RNA
attgctcagggactcatcttt

SEQ ID NO: 74 - RNA, 21 nt, synthetic construct
  misc_feature 1..21: note = Synthetic
  source 1..21: mol_type = other RNA
caaagctgaagagcacacagt

SEQ ID NO: 75 - RNA, 21 nt, synthetic construct
  misc_feature 1..21: note = Synthetic
  source 1..21: mol_type = other RNA
caaatgtacccacaagggcct

SEQ ID NO: 76 - RNA, 21 nt, synthetic construct
  misc_feature 1..21: note = Synthetic
  source 1..21: mol_type = other RNA
caagaaagtgaaagaccactt

SEQ ID NO: 77 - RNA, 21 nt, synthetic construct
  misc_feature 1..21: note = Synthetic
  source 1..21: mol_type = other RNA
caagagtctgtcttcgatgat

SEQ ID NO: 78 - RNA, 21 nt, synthetic construct
  misc_feature 1..21: note = Synthetic
  source 1..21: mol_type = other RNA
caaggagcataagtacaaagt

SEQ ID NO: 79 - RNA, 21 nt, synthetic construct
  misc_feature 1..21: note = Synthetic
  source 1..21: mol_type = other RNA
cacaaatgtacccacaagggt

SEQ ID NO: 80 - RNA, 21 nt, synthetic construct
  misc_feature 1..21: note = Synthetic
  source 1..21: mol_type = other RNA
caccctgcaaggcatcatcat

SEQ ID NO: 81 - RNA, 21 nt, synthetic construct
  misc_feature 1..21: note = Synthetic
  source 1..21: mol_type = other RNA
caccgatgtggcctactacct

SEQ ID NO: 82 - RNA, 21 nt, synthetic construct
  misc_feature 1..21: note = Synthetic
  source 1..21: mol_type = other RNA
cacgacctggctctgttgcgt

SEQ ID NO: 83 - RNA, 21 nt, synthetic construct
  misc_feature 1..21: note = Synthetic
  source 1..21: mol_type = other RNA
cactgtctctgtccacaacat

SEQ ID NO: 84 - RNA, 21 nt, synthetic construct
  misc_feature 1..21: note = Synthetic
  source 1..21: mol_type = other RNA
cactttcgattccaccttggt

SEQ ID NO: 85 - RNA, 21 nt, synthetic construct
  misc_feature 1..21: note = Synthetic
  source 1..21: mol_type = other RNA
cagatgccagtgcaagggtct

SEQ ID NO: 86 - RNA, 21 nt, synthetic construct
  misc_feature 1..21: note = Synthetic
  source 1..21: mol_type = other RNA
cagcacgacctggctctgttt

SEQ ID NO: 87 - RNA, 21 nt, synthetic construct
  misc_feature 1..21: note = Synthetic
  source 1..21: mol_type = other RNA
cagctgtaccacaaatgtact

SEQ ID NO: 88 - RNA, 21 nt, synthetic construct
  misc_feature 1..21: note = Synthetic
  source 1..21: mol_type = other RNA
cagctgtggccagatgccagt

SEQ ID NO: 89 - RNA, 21 nt, synthetic construct
  misc_feature 1..21: note = Synthetic
  source 1..21: mol_type = other RNA
caggaactcaataaagtgctt

SEQ ID NO: 90 - RNA, 21 nt, synthetic construct
  misc_feature 1..21: note = Synthetic
  source 1..21: mol_type = other RNA
caggatggcgcaggaactcat

SEQ ID NO: 91 - RNA, 21 nt, synthetic construct
  misc_feature 1..21: note = Synthetic
  source 1..21: mol_type = other RNA
caggcgtctacaccgatgtgt

SEQ ID NO: 92 - RNA, 21 nt, synthetic construct
  misc_feature 1..21: note = Synthetic
  source 1..21: mol_type = other RNA
cagggactcatctttccctct

SEQ ID NO: 93 - RNA, 21 nt, synthetic construct
  misc_feature 1..21: note = Synthetic
  source 1..21: mol_type = other RNA
cagtgcaagggtcctgatgct

SEQ ID NO: 94 - RNA, 21 nt, synthetic construct
  misc_feature 1..21: note = Synthetic
  source 1..21: mol_type = other RNA
ccacaaatgtacccacaaggt

SEQ ID NO: 95 - RNA, 21 nt, synthetic construct
  misc_feature 1..21: note = Synthetic
  source 1..21: mol_type = other RNA
ccacaaatgtacccacaaggt

SEQ ID NO: 96 - RNA, 21 nt, synthetic construct
  misc_feature 1..21: note = Synthetic
  source 1..21: mol_type = other RNA
ccagatgccagtgcaagggtt

SEQ ID NO: 97 - RNA, 21 nt, synthetic construct
  misc_feature 1..21: note = Synthetic
  source 1..21: mol_type = other RNA
ccaggcgtctacaccgatgtt

SEQ ID NO: 98 - RNA, 21 nt, synthetic construct
  misc_feature 1..21: note = Synthetic
  source 1..21: mol_type = other RNA
cccaagaaagtgaaagaccat

SEQ ID NO: 99 - RNA, 21 nt, synthetic construct
  misc_feature 1..21: note = Synthetic
  source 1..21: mol_type = other RNA
cccggacaacgacatccgcct

SEQ ID NO: 100 - RNA, 21 nt, synthetic construct
  misc_feature 1..21: note = Synthetic
  source 1..21: mol_type = other RNA
cccggacaacgacatccgcct

SEQ ID NO: 101 - RNA, 21 nt, synthetic construct
  misc_feature 1..21: note = Synthetic
  source 1..21: mol_type = other RNA
ccctgcaaggcatcatcagct

SEQ ID NO: 102 - RNA, 21 nt, synthetic construct
  misc_feature 1..21: note = Synthetic
  source 1..21: mol_type = other RNA
ccgatgtggcctactacctgt

SEQ ID NO: 103 - RNA, 21 nt, synthetic construct
  misc_feature 1..21: note = Synthetic
  source 1..21: mol_type = other RNA
ccgcaacaagccaggcgtctt

SEQ ID NO: 104 - RNA, 21 nt, synthetic construct
  misc_feature 1..21: note = Synthetic
  source 1..21: mol_type = other RNA
ccgcaagagtctgtcttcgat

SEQ ID NO: 105 - RNA, 21 nt, synthetic construct
  misc_feature 1..21: note = Synthetic
  source 1..21: mol_type = other RNA
ccggaacccggacaacgacat

SEQ ID NO: 106 - RNA, 21 nt, synthetic construct
  misc_feature 1..21: note = Synthetic
  source 1..21: mol_type = other RNA
ccggaacccggacaacgacat

SEQ ID NO: 107 - RNA, 21 nt, synthetic construct
  misc_feature 1..21: note = Synthetic
  source 1..21: mol_type = other RNA
cctgcaggaggcgcaggtact

SEQ ID NO: 108 - RNA, 21 nt, synthetic construct
  misc_feature 1..21: note = Synthetic
  source 1..21: mol_type = other RNA
cctgtcgccttacgttcagct

SEQ ID NO: 109 - RNA, 21 nt, synthetic construct
  misc_feature 1..21: note = Synthetic
  source 1..21: mol_type = other RNA
cctgtcgccttacgttcagct

SEQ ID NO: 110 - RNA, 21 nt, synthetic construct
  misc_feature 1..21: note = Synthetic
  source 1..21: mol_type = other RNA
ccttacgttcagccggtgtgt

SEQ ID NO: 111 - RNA, 21 nt, synthetic construct
  misc_feature 1..21: note = Synthetic
  source 1..21: mol_type = other RNA
cgcaacaagccaggcgtctat

SEQ ID NO: 112 - RNA, 21 nt, synthetic construct
  misc_feature 1..21: note = Synthetic
  source 1..21: mol_type = other RNA
cgcaggaactcaataaagtgt

SEQ ID NO: 113 - RNA, 21 nt, synthetic construct
  misc_feature 1..21: note = Synthetic
  source 1..21: mol_type = other RNA
cgccttacgttcagccggtgt

SEQ ID NO: 114 - RNA, 21 nt, synthetic construct
  misc_feature 1..21: note = Synthetic
  source 1..21: mol_type = other RNA
cgctcctgtcgccttacgttt

SEQ ID NO: 115 - RNA, 21 nt, synthetic construct
  misc_feature 1..21: note = Synthetic
  source 1..21: mol_type = other RNA
cggaacccggacaacgacatt

SEQ ID NO: 116 - RNA, 21 nt, synthetic construct
  misc_feature 1..21: note = Synthetic
  source 1..21: mol_type = other RNA
cggctccgcaagagtctgtct

SEQ ID NO: 117 - RNA, 21 nt, synthetic construct
  misc_feature 1..21: note = Synthetic
  source 1..21: mol_type = other RNA
cgtctacaccgatgtggcctt

SEQ ID NO: 118 - RNA, 21 nt, synthetic construct
  misc_feature 1..21: note = Synthetic
  source 1..21: mol_type = other RNA
cgtgccagggtgattccggat

SEQ ID NO: 119 - RNA, 21 nt, synthetic construct
  misc_feature 1..21: note = Synthetic
  source 1..21: mol_type = other RNA
ctacatcgccgcgctgtactt

SEQ ID NO: 120 - RNA, 21 nt, synthetic construct
  misc_feature 1..21: note = Synthetic
  source 1..21: mol_type = other RNA
ctacctggcctggatccgggt

SEQ ID NO: 121 - RNA, 21 nt, synthetic construct
  misc_feature 1..21: note = Synthetic
  source 1..21: mol_type = other RNA
ctcaataaagtgctttgaaat

SEQ ID NO: 122 - RNA, 21 nt, synthetic construct
  misc_feature 1..21: note = Synthetic
  source 1..21: mol_type = other RNA
ctcaataaagtgctttgaaat

SEQ ID NO: 123 - RNA, 21 nt, synthetic construct
  misc_feature 1..21: note = Synthetic
  source 1..21: mol_type = other RNA
ctcagggactcatctttccct

SEQ ID NO: 124 - RNA, 21 nt, synthetic construct
  misc_feature 1..21: note = Synthetic
  source 1..21: mol_type = other RNA
ctcctgtcgccttacgttcat

SEQ ID NO: 125 - RNA, 21 nt, synthetic construct
  misc_feature 1..21: note = Synthetic
  source 1..21: mol_type = other RNA
ctctgttgcgccttcaggagt

SEQ ID NO: 126 - RNA, 21 nt, synthetic construct
  misc_feature 1..21: note = Synthetic
  source 1..21: mol_type = other RNA
ctgaagagcacacagtcgttt

SEQ ID NO: 127 - RNA, 21 nt, synthetic construct
  misc_feature 1..21: note = Synthetic
  source 1..21: mol_type = other RNA
ctgattgctcagggactcatt

SEQ ID NO: 128 - RNA, 21 nt, synthetic construct
  misc_feature 1..21: note = Synthetic
  source 1..21: mol_type = other RNA
ctgcaaggcatcatcagctgt

SEQ ID NO: 129 - RNA, 21 nt, synthetic construct
  misc_feature 1..21: note = Synthetic
  source 1..21: mol_type = other RNA
ctgccggaacccggacaacgt

SEQ ID NO: 130 - RNA, 21 nt, synthetic construct
  misc_feature 1..21: note = Synthetic
  source 1..21: mol_type = other RNA
ctgtaccacaaatgtacccat

SEQ ID NO: 131 - RNA, 21 nt, synthetic construct
  misc_feature 1..21: note = Synthetic
  source 1..21: mol_type = other RNA
ctgtcgccttacgttcagcct

SEQ ID NO: 132 - RNA, 21 nt, synthetic construct
  misc_feature 1..21: note = Synthetic
  source 1..21: mol_type = other RNA
ctgtctctgtccacaacacct

SEQ ID NO: 133 - RNA, 21 nt, synthetic construct
  misc_feature 1..21: note = Synthetic
  source 1..21: mol_type = other RNA
ctgtggtgaccgcaacaagct

SEQ ID NO: 134 - RNA, 21 nt, synthetic construct
  misc_feature 1..21: note = Synthetic
  source 1..21: mol_type = other RNA
cttacgttcagccggtgtgct

SEQ ID NO: 135 - RNA, 21 nt, synthetic construct
  misc_feature 1..21: note = Synthetic
  source 1..21: mol_type = other RNA
cttcgatgacccgcgtcgttt

SEQ ID NO: 136 - RNA, 21 nt, synthetic construct
  misc_feature 1..21: note = Synthetic
  source 1..21: mol_type = other RNA
cttggagtcaacactttcgat

SEQ ID NO: 137 - RNA, 21 nt, synthetic construct
  misc_feature 1..21: note = Synthetic
  source 1..21: mol_type = other RNA
ctttgagcctcagcttctcct

SEQ ID NO: 138 - RNA, 21 nt, synthetic construct
  misc_feature 1..21: note = Synthetic
  source 1..21: mol_type = other RNA
gaaagtgaaagaccactgcat

SEQ ID NO: 139 - RNA, 21 nt, synthetic construct
  misc_feature 1..21: note = Synthetic
  source 1..21: mol_type = other RNA
gaacccggacaacgacatcct

SEQ ID NO: 140 - RNA, 21 nt, synthetic construct
  misc_feature 1..21: note = Synthetic
  source 1..21: mol_type = other RNA
gaactcaataaagtgctttgt

SEQ ID NO: 141 - RNA, 21 nt, synthetic construct
  misc_feature 1..21: note = Synthetic
  source 1..21: mol_type = other RNA
gaagagcacacagtcgttctt

SEQ ID NO: 142 - RNA, 21 nt, synthetic construct
  misc_feature 1..21: note = Synthetic
  source 1..21: mol_type = other RNA
gaccgcaacaagccaggcgtt

SEQ ID NO: 143 - RNA, 21 nt, synthetic construct
  misc_feature 1..21: note = Synthetic
  source 1..21: mol_type = other RNA
gagcacacagtcgttctcact

SEQ ID NO: 144 - RNA, 21 nt, synthetic construct
  misc_feature 1..21: note = Synthetic
  source 1..21: mol_type = other RNA
gagcataagtacaaagctgat

SEQ ID NO: 145 - RNA, 21 nt, synthetic construct
  misc_feature 1..21: note = Synthetic
  source 1..21: mol_type = other RNA
gagcctcagcttctccggttt

SEQ ID NO: 146 - RNA, 21 nt, synthetic construct
  misc_feature 1..21: note = Synthetic
  source 1..21: mol_type = other RNA
gagtctgtcttcgatgaccct

SEQ ID NO: 147 - RNA, 21 nt, synthetic construct
  misc_feature 1..21: note = Synthetic
  source 1..21: mol_type = other RNA
gatgccagtgcaagggtcctt

SEQ ID NO: 148 - RNA, 21 nt, synthetic construct
  misc_feature 1..21: note = Synthetic
  source 1..21: mol_type = other RNA
gatggcgcaggaactcaatat

SEQ ID NO: 149 - RNA, 21 nt, synthetic construct
  misc_feature 1..21: note = Synthetic
  source 1..21: mol_type = other RNA
gattgctcagggactcatctt

SEQ ID NO: 150 - RNA, 21 nt, synthetic construct
  misc_feature 1..21: note = Synthetic
  source 1..21: mol_type = other RNA
gcaagagtctgtcttcgatgt

SEQ ID NO: 151 - RNA, 21 nt, synthetic construct
  misc_feature 1..21: note = Synthetic
  source 1..21: mol_type = other RNA
gcacacagtcgttctcactgt

SEQ ID NO: 152 - RNA, 21 nt, synthetic construct
  misc_feature 1..21: note = Synthetic
  source 1..21: mol_type = other RNA
gcacgacctggctctgttgct

SEQ ID NO: 153 - RNA, 21 nt, synthetic construct
  misc_feature 1..21: note = Synthetic
  source 1..21: mol_type = other RNA
gcacgacctggctctgttgct

SEQ ID NO: 154 - RNA, 21 nt, synthetic construct
  misc_feature 1..21: note = Synthetic
  source 1..21: mol_type = other RNA
gcagctgtggccagatgccat

SEQ ID NO: 155 - RNA, 21 nt, synthetic construct
  misc_feature 1..21: note = Synthetic
  source 1..21: mol_type = other RNA
gcaggaactcaataaagtgct

SEQ ID NO: 156 - RNA, 21 nt, synthetic construct
  misc_feature 1..21: note = Synthetic
  source 1..21: mol_type = other RNA
gccagatgccagtgcaagggt

SEQ ID NO: 157 - RNA, 21 nt, synthetic construct
  misc_feature 1..21: note = Synthetic
  source 1..21: mol_type = other RNA
gccaggcgtctacaccgatgt

SEQ ID NO: 158 - RNA, 21 nt, synthetic construct
  misc_feature 1..21: note = Synthetic
  source 1..21: mol_type = other RNA
gcccaagaaagtgaaagacct

SEQ ID NO: 159 - RNA, 21 nt, synthetic construct
  misc_feature 1..21: note = Synthetic
  source 1..21: mol_type = other RNA
gccttacgttcagccggtgtt

SEQ ID NO: 160 - RNA, 21 nt, synthetic construct
  misc_feature 1..21: note = Synthetic
  source 1..21: mol_type = other RNA
gcgcaggaactcaataaagtt

SEQ ID NO: 161 - RNA, 21 nt, synthetic construct
  misc_feature 1..21: note = Synthetic
  source 1..21: mol_type = other RNA
gcgccttcaggaggatgcggt

SEQ ID NO: 162 - RNA, 21 nt, synthetic construct
  misc_feature 1..21: note = Synthetic
  source 1..21: mol_type = other RNA
gcggctccgcaagagtctgtt

SEQ ID NO: 163 - RNA, 21 nt, synthetic construct
  misc_feature 1..21: note = Synthetic
  source 1..21: mol_type = other RNA
gctcagggactcatctttcct

SEQ ID NO: 164 - RNA, 21 nt, synthetic construct
  misc_feature 1..21: note = Synthetic
  source 1..21: mol_type = other RNA
gctccgcaagagtctgtcttt

SEQ ID NO: 165 - RNA, 21 nt, synthetic construct
  misc_feature 1..21: note = Synthetic
  source 1..21: mol_type = other RNA
gctcctgtcgccttacgttct

SEQ ID NO: 166 - RNA, 21 nt, synthetic construct
  misc_feature 1..21: note = Synthetic
  source 1..21: mol_type = other RNA
gctctgcgcagggttcctcgt

SEQ ID NO: 167 - RNA, 21 nt, synthetic construct
  misc_feature 1..21: note = Synthetic
  source 1..21: mol_type = other RNA
gctctgcgcagggttcctcgt

SEQ ID NO: 168 - RNA, 21 nt, synthetic construct
  misc_feature 1..21: note = Synthetic
  source 1..21: mol_type = other RNA
gctctgttgcgccttcaggat

SEQ ID NO: 169 - RNA, 21 nt, synthetic construct
  misc_feature 1..21: note = Synthetic
  source 1..21: mol_type = other RNA
gctctgttgcgccttcaggat

SEQ ID NO: 170 - RNA, 21 nt, synthetic construct
  misc_feature 1..21: note = Synthetic
  source 1..21: mol_type = other RNA
gctgaagagcacacagtcgtt

SEQ ID NO: 171 - RNA, 21 nt, synthetic construct
  misc_feature 1..21: note = Synthetic
  source 1..21: mol_type = other RNA
gctgctatgatggccgcgggt

SEQ ID NO: 172 - RNA, 21 nt, synthetic construct
  misc_feature 1..21: note = Synthetic
  source 1..21: mol_type = other RNA
gctggtgtgtgaggaccaagt

SEQ ID NO: 173 - RNA, 21 nt, synthetic construct
  misc_feature 1..21: note = Synthetic
  source 1..21: mol_type = other RNA
gctgtggtgaccgcaacaagt

SEQ ID NO: 174 - RNA, 21 nt, synthetic construct
  misc_feature 1..21: note = Synthetic
  source 1..21: mol_type = other RNA
gctgtggtgaccgcaacaagt

SEQ ID NO: 175 - RNA, 21 nt, synthetic construct
  misc_feature 1..21: note = Synthetic
  source 1..21: mol_type = other RNA
gcttcatgtcccactcatgct

SEQ ID NO: 176 - RNA, 21 nt, synthetic construct
  misc_feature 1..21: note = Synthetic
  source 1..21: mol_type = other RNA
gctttgagcctcagcttctct

SEQ ID NO: 177 - RNA, 21 nt, synthetic construct
  misc_feature 1..21: note = Synthetic
  source 1..21: mol_type = other RNA
ggaactcaataaagtgctttt

SEQ ID NO: 178 - RNA, 21 nt, synthetic construct
  misc_feature 1..21: note = Synthetic
  source 1..21: mol_type = other RNA
ggagcataagtacaaagctgt

SEQ ID NO: 179 - RNA, 21 nt, synthetic construct
  misc_feature 1..21: note = Synthetic
  source 1..21: mol_type = other RNA
ggagcccaagaaagtgaaagt

SEQ ID NO: 180 - RNA, 21 nt, synthetic construct
  misc_feature 1..21: note = Synthetic
  source 1..21: mol_type = other RNA
ggagtcaacactttcgattct

SEQ ID NO: 181 - RNA, 21 nt, synthetic construct
  misc_feature 1..21: note = Synthetic
  source 1..21: mol_type = other RNA
ggcgtctacaccgatgtggct

SEQ ID NO: 182 - RNA, 21 nt, synthetic construct
  misc_feature 1..21: note = Synthetic
  source 1..21: mol_type = other RNA
ggcgtctacaccgatgtggct

SEQ ID NO: 183 - RNA, 21 nt, synthetic construct
  misc_feature 1..21: note = Synthetic
  source 1..21: mol_type = other RNA
ggctccgcaagagtctgtctt

SEQ ID NO: 184 - RNA, 21 nt, synthetic construct
  misc_feature 1..21: note = Synthetic
  source 1..21: mol_type = other RNA
ggctctgttgcgccttcaggt

SEQ ID NO: 185 - RNA, 21 nt, synthetic construct
  misc_feature 1..21: note = Synthetic
  source 1..21: mol_type = other RNA
gggtcctgatgcccactgcct

SEQ ID NO: 186 - RNA, 21 nt, synthetic construct
  misc_feature 1..21: note = Synthetic
  source 1..21: mol_type = other RNA
gtcaacactttcgattccact

SEQ ID NO: 187 - RNA, 21 nt, synthetic construct
  misc_feature 1..21: note = Synthetic
  source 1..21: mol_type = other RNA
gtcaacactttcgattccact

SEQ ID NO: 188 - RNA, 21 nt, synthetic construct
  misc_feature 1..21: note = Synthetic
  source 1..21: mol_type = other RNA
gtcgccttacgttcagccggt

SEQ ID NO: 189 - RNA, 21 nt, synthetic construct
  misc_feature 1..21: note = Synthetic
  source 1..21: mol_type = other RNA
gtcgccttacgttcagccggt

SEQ ID NO: 190 - RNA, 21 nt, synthetic construct
  misc_feature 1..21: note = Synthetic
  source 1..21: mol_type = other RNA
gtcgttctcactgtcaccggt

SEQ ID NO: 191 - RNA, 21 nt, synthetic construct
  misc_feature 1..21: note = Synthetic
  source 1..21: mol_type = other RNA
gtctgtcttcgatgacccgct

SEQ ID NO: 192 - RNA, 21 nt, synthetic construct
  misc_feature 1..21: note = Synthetic
  source 1..21: mol_type = other RNA
gtcttcgatgacccgcgtcgt

SEQ ID NO: 193 - RNA, 21 nt, synthetic construct
  misc_feature 1..21: note = Synthetic
  source 1..21: mol_type = other RNA
gtgcaagggtcctgatgccct

SEQ ID NO: 194 - RNA, 21 nt, synthetic construct
  misc_feature 1..21: note = Synthetic
  source 1..21: mol_type = other RNA
gtggtgaccgcaacaagccat

SEQ ID NO: 195 - RNA, 21 nt, synthetic construct
  misc_feature 1..21: note = Synthetic
  source 1..21: mol_type = other RNA
gttgcgccttcaggaggatgt

SEQ ID NO: 196 - RNA, 21 nt, synthetic construct
  misc_feature 1..21: note = Synthetic
  source 1..21: mol_type = other RNA
gttgcgccttcaggaggatgt

SEQ ID NO: 197 - RNA, 21 nt, synthetic construct
  misc_feature 1..21: note = Synthetic
  source 1..21: mol_type = other RNA
taagtacaaagctgaagagct

SEQ ID NO: 198 - RNA, 21 nt, synthetic construct
  misc_feature 1..21: note = Synthetic
  source 1..21: mol_type = other RNA
taagtacaaagctgaagagct

SEQ ID NO: 199 - RNA, 21 nt, synthetic construct
  misc_feature 1..21: note = Synthetic
  source 1..21: mol_type = other RNA
tacatcgccgcgctgtactgt

SEQ ID NO: 200 - RNA, 21 nt, synthetic construct
  misc_feature 1..21: note = Synthetic
  source 1..21: mol_type = other RNA
tacctggcctggatccgggat

SEQ ID NO: 201 - RNA, 21 nt, synthetic construct
  misc_feature 1..21: note = Synthetic
  source 1..21: mol_type = other RNA
tactacctggcctggatccgt

SEQ ID NO: 202 - RNA, 21 nt, synthetic construct
  misc_feature 1..21: note = Synthetic
  source 1..21: mol_type = other RNA
tcaacactttcgattccacct

SEQ ID NO: 203 - RNA, 21 nt, synthetic construct
  misc_feature 1..21: note = Synthetic
  source 1..21: mol_type = other RNA
tcaccctgcaaggcatcatct

SEQ ID NO: 204 - RNA, 21 nt, synthetic construct
  misc_feature 1..21: note = Synthetic
  source 1..21: mol_type = other RNA
tcagccggtgtgcctgccaat

SEQ ID NO: 205 - RNA, 21 nt, synthetic construct
  misc_feature 1..21: note = Synthetic
  source 1..21: mol_type = other RNA
tcaggaggatgcggacggcat

SEQ ID NO: 206 - RNA, 21 nt, synthetic construct
  misc_feature 1..21: note = Synthetic
  source 1..21: mol_type = other RNA
tcagggactcatctttccctt

SEQ ID NO: 207 - RNA, 21 nt, synthetic construct
  misc_feature 1..21: note = Synthetic
  source 1..21: mol_type = other RNA
tccgcaagagtctgtcttcgt

SEQ ID NO: 208 - RNA, 21 nt, synthetic construct
  misc_feature 1..21: note = Synthetic
  source 1..21: mol_type = other RNA
tcctgtcgccttacgttcagt

SEQ ID NO: 209 - RNA, 21 nt, synthetic construct
  misc_feature 1..21: note = Synthetic
  source 1..21: mol_type = other RNA
tcgccttacgttcagccggtt

SEQ ID NO: 210 - RNA, 21 nt, synthetic construct
  misc_feature 1..21: note = Synthetic
  source 1..21: mol_type = other RNA
tctctgtccacaacacctcat

SEQ ID NO: 211 - RNA, 21 nt, synthetic construct
  misc_feature 1..21: note = Synthetic
  source 1..21: mol_type = other RNA
tctgttgcgccttcaggaggt

SEQ ID NO: 212 - RNA, 21 nt, synthetic construct
  misc_feature 1..21: note = Synthetic
  source 1..21: mol_type = other RNA
tgaagagcacacagtcgttct

SEQ ID NO: 213 - RNA, 21 nt, synthetic construct
  misc_feature 1..21: note = Synthetic
  source 1..21: mol_type = other RNA
tgagcctcagcttctccggtt

SEQ ID NO: 214 - RNA, 21 nt, synthetic construct
  misc_feature 1..21: note = Synthetic
  source 1..21: mol_type = other RNA
tgagctgggagtactgcgact

SEQ ID NO: 215 - RNA, 21 nt, synthetic construct
  misc_feature 1..21: note = Synthetic
  source 1..21: mol_type = other RNA
tgatggccgcgggctcagctt

SEQ ID NO: 216 - RNA, 21 nt, synthetic construct
  misc_feature 1..21: note = Synthetic
  source 1..21: mol_type = other RNA
tgcaaggcatcatcagctggt

SEQ ID NO: 217 - RNA, 21 nt, synthetic construct
  misc_feature 1..21: note = Synthetic
  source 1..21: mol_type = other RNA
tgcaaggcatcatcagctggt

SEQ ID NO: 218 - RNA, 21 nt, synthetic construct
  misc_feature 1..21: note = Synthetic
  source 1..21: mol_type = other RNA
tgcaagggtcctgatgcccat

SEQ ID NO: 219 - RNA, 21 nt, synthetic construct
  misc_feature 1..21: note = Synthetic
  source 1..21: mol_type = other RNA
tgccagtgcaagggtcctgat

SEQ ID NO: 220 - RNA, 21 nt, synthetic construct
  misc_feature 1..21: note = Synthetic
  source 1..21: mol_type = other RNA
tgccatgagggctctgctgct

SEQ ID NO: 221 - RNA, 21 nt, synthetic construct
  misc_feature 1..21: note = Synthetic
  source 1..21: mol_type = other RNA
tgcgccttcaggaggatgcgt

SEQ ID NO: 222 - RNA, 21 nt, synthetic construct
  misc_feature 1..21: note = Synthetic
  source 1..21: mol_type = other RNA
tgctcagggactcatctttct

SEQ ID NO: 223 - RNA, 21 nt, synthetic construct
  misc_feature 1..21: note = Synthetic
  source 1..21: mol_type = other RNA
tgctcagggactcatctttct

SEQ ID NO: 224 - RNA, 21 nt, synthetic construct
  misc_feature 1..21: note = Synthetic
  source 1..21: mol_type = other RNA
tggagtcaacactttcgattt

SEQ ID NO: 225 - RNA, 21 nt, synthetic construct
  misc_feature 1..21: note = Synthetic
  source 1..21: mol_type = other RNA
tggccagatgccagtgcaagt

SEQ ID NO: 226 - RNA, 21 nt, synthetic construct
  misc_feature 1..21: note = Synthetic
  source 1..21: mol_type = other RNA
tggcctactacctggcctggt

SEQ ID NO: 227 - RNA, 21 nt, synthetic construct
  misc_feature 1..21: note = Synthetic
  source 1..21: mol_type = other RNA
tggctctgttgcgccttcagt

SEQ ID NO: 228 - RNA, 21 nt, synthetic construct
  misc_feature 1..21: note = Synthetic
  source 1..21: mol_type = other RNA
tggtgaccgcaacaagccagt

SEQ ID NO: 229 - RNA, 21 nt, synthetic construct
  misc_feature 1..21: note = Synthetic
  source 1..21: mol_type = other RNA
tgtaccacaaatgtacccact

SEQ ID NO: 230 - RNA, 21 nt, synthetic construct
  misc_feature 1..21: note = Synthetic
  source 1..21: mol_type = other RNA
tgtctctgtccacaacacctt

SEQ ID NO: 231 - RNA, 21 nt, synthetic construct
  misc_feature 1..21: note = Synthetic
  source 1..21: mol_type = other RNA
tgtggccagatgccagtgcat

SEQ ID NO: 232 - RNA, 21 nt, synthetic construct
  misc_feature 1..21: note = Synthetic
  source 1..21: mol_type = other RNA
ttacgttcagccggtgtgcct

SEQ ID NO: 233 - RNA, 21 nt, synthetic construct
  misc_feature 1..21: note = Synthetic
  source 1..21: mol_type = other RNA
ttcatgtcccactcatgccct

SEQ ID NO: 234 - RNA, 21 nt, synthetic construct
  misc_feature 1..21: note = Synthetic
  source 1..21: mol_type = other RNA
ttcgatgacccgcgtcgttgt

SEQ ID NO: 235 - RNA, 21 nt, synthetic construct
  misc_feature 1..21: note = Synthetic
  source 1..21: mol_type = other RNA
ttgagcctcagcttctccggt

SEQ ID NO: 236 - RNA, 21 nt, synthetic construct
  misc_feature 1..21: note = Synthetic
  source 1..21: mol_type = other RNA
ttggagcccaagaaagtgaat

SEQ ID NO: 237 - RNA, 21 nt, synthetic construct
  misc_feature 1..21: note = Synthetic
  source 1..21: mol_type = other RNA
ttggagtcaacactttcgatt

SEQ ID NO: 238 - RNA, 21 nt, synthetic construct
  misc_feature 1..21: note = Synthetic
  source 1..21: mol_type = other RNA
tttgagcctcagcttctccgt

SEQ ID NO: 239 - RNA, 21 nt, synthetic construct
  misc_feature 1..21: note = Synthetic
  source 1..21: mol_type = other RNA
aagagcacacagtcgttctct

SEQ ID NO: 240 - RNA, 21 nt, synthetic construct
  misc_feature 1..21: note = Synthetic
  source 1..21: mol_type = other RNA
aataaagtgctttgaaaatgt

SEQ ID NO: 241 - RNA, 21 nt, synthetic construct
  misc_feature 1..21: note = Synthetic
  source 1..21: mol_type = other RNA
acatcgccgcgctgtactggt

SEQ ID NO: 242 - RNA, 21 nt, synthetic construct
  misc_feature 1..21: note = Synthetic
  source 1..21: mol_type = other RNA
accagcacgacctggctctgt

SEQ ID NO: 243 - RNA, 21 nt, synthetic construct
  misc_feature 1..21: note = Synthetic
  source 1..21: mol_type = other RNA
accctgcaaggcatcatcagt

SEQ ID NO: 244 - RNA, 21 nt, synthetic construct
  misc_feature 1..21: note = Synthetic
  source 1..21: mol_type = other RNA
accgcaacaagccaggcgtct

SEQ ID NO: 245 - RNA, 21 nt, synthetic construct
  misc_feature 1..21: note = Synthetic
  source 1..21: mol_type = other RNA
actacctggcctggatccggt

SEQ ID NO: 246 - RNA, 21 nt, synthetic construct
  misc_feature 1..21: note = Synthetic
  source 1..21: mol_type = other RNA
attgctcagggactcatcttt

SEQ ID NO: 247 - RNA, 21 nt, synthetic construct
  misc_feature 1..21: note = Synthetic
  source 1..21: mol_type = other RNA
cagggactcatctttccctct

SEQ ID NO: 248 - RNA, 21 nt, synthetic construct
  misc_feature 1..21: note = Synthetic
  source 1..21: mol_type = other RNA
ccacaaatgtacccacaaggt

SEQ ID NO: 249 - RNA, 21 nt, synthetic construct
  misc_feature 1..21: note = Synthetic
  source 1..21: mol_type = other RNA
ccgcaagagtctgtcttcgat

SEQ ID NO: 250 - RNA, 21 nt, synthetic construct
  misc_feature 1..21: note = Synthetic
  source 1..21: mol_type = other RNA
ccggaacccggacaacgacat

SEQ ID NO: 251 - RNA, 21 nt, synthetic construct
  misc_feature 1..21: note = Synthetic
  source 1..21: mol_type = other RNA
cctgtcgccttacgttcagct

SEQ ID NO: 252 - RNA, 21 nt, synthetic construct
  misc_feature 1..21: note = Synthetic
  source 1..21: mol_type = other RNA
cgccttacgttcagccggtgt

SEQ ID NO: 253 - RNA, 21 nt, synthetic construct
  misc_feature 1..21: note = Synthetic
  source 1..21: mol_type = other RNA
cgtgccagggtgattccggat

SEQ ID NO: 254 - RNA, 21 nt, synthetic construct
  misc_feature 1..21: note = Synthetic
  source 1..21: mol_type = other RNA
ctacctggcctggatccgggt

SEQ ID NO: 255 - RNA, 21 nt, synthetic construct
  misc_feature 1..21: note = Synthetic
  source 1..21: mol_type = other RNA
ctcagggactcatctttccct

SEQ ID NO: 256 - RNA, 21 nt, synthetic construct
  misc_feature 1..21: note = Synthetic
  source 1..21: mol_type = other RNA
cttcgatgacccgcgtcgttt

SEQ ID NO: 257 - RNA, 21 nt, synthetic construct
  misc_feature 1..21: note = Synthetic
  source 1..21: mol_type = other RNA
gaagagcacacagtcgttctt

SEQ ID NO: 258 - RNA, 21 nt, synthetic construct
  misc_feature 1..21: note = Synthetic
  source 1..21: mol_type = other RNA
gagcctcagcttctccggttt

SEQ ID NO: 259 - RNA, 21 nt, synthetic construct
  misc_feature 1..21: note = Synthetic
  source 1..21: mol_type = other RNA
gccagatgccagtgcaagggt

SEQ ID NO: 260 - RNA, 21 nt, synthetic construct
  misc_feature 1..21: note = Synthetic
  source 1..21: mol_type = other RNA
gccttacgttcagccggtgtt

SEQ ID NO: 261 - RNA, 21 nt, synthetic construct
  misc_feature 1..21: note = Synthetic
  source 1..21: mol_type = other RNA
gcgcaggaactcaataaagtt

SEQ ID NO: 262 - RNA, 21 nt, synthetic construct
  misc_feature 1..21: note = Synthetic
  source 1..21: mol_type = other RNA
gcgccttcaggaggatgcggt

SEQ ID NO: 263 - RNA, 21 nt, synthetic construct
  misc_feature 1..21: note = Synthetic
  source 1..21: mol_type = other RNA
gctcagggactcatctttcct

SEQ ID NO: 264 - RNA, 21 nt, synthetic construct
  misc_feature 1..21: note = Synthetic
  source 1..21: mol_type = other RNA
gctctgcgcagggttcctcgt

SEQ ID NO: 265 - RNA, 21 nt, synthetic construct
  misc_feature 1..21: note = Synthetic
  source 1..21: mol_type = other RNA
gctctgttgcgccttcaggat

SEQ ID NO: 266 - RNA, 21 nt, synthetic construct
  misc_feature 1..21: note = Synthetic
  source 1..21: mol_type = other RNA
gctttgagcctcagcttctct

SEQ ID NO: 267 - RNA, 21 nt, synthetic construct
  misc_feature 1..21: note = Synthetic
  source 1..21: mol_type = other RNA
ggagtcaacactttcgattct

SEQ ID NO: 268 - RNA, 21 nt, synthetic construct
  misc_feature 1..21: note = Synthetic
  source 1..21: mol_type = other RNA
ggctctgttgcgccttcaggt

SEQ ID NO: 269 - RNA, 21 nt, synthetic construct
  misc_feature 1..21: note = Synthetic
  source 1..21: mol_type = other RNA
gtcgccttacgttcagccggt

SEQ ID NO: 270 - RNA, 21 nt, synthetic construct
  misc_feature 1..21: note = Synthetic
  source 1..21: mol_type = other RNA
gtcttcgatgacccgcgtcgt

SEQ ID NO: 271 - RNA, 21 nt, synthetic construct
  misc_feature 1..21: note = Synthetic
  source 1..21: mol_type = other RNA
gttgcgccttcaggaggatgt

SEQ ID NO: 272 - RNA, 21 nt, synthetic construct
  misc_feature 1..21: note = Synthetic
  source 1..21: mol_type = other RNA
tcgccttacgttcagccggtt

SEQ ID NO: 273 - RNA, 21 nt, synthetic construct
  misc_feature 1..21: note = Synthetic
  source 1..21: mol_type = other RNA
tgagcctcagcttctccggtt

SEQ ID NO: 274 - RNA, 21 nt, synthetic construct
  misc_feature 1..21: note = Synthetic
  source 1..21: mol_type = other RNA
tgcgccttcaggaggatgcgt

SEQ ID NO: 275 - RNA, 21 nt, synthetic construct
  misc_feature 1..21: note = Synthetic
  source 1..21: mol_type = other RNA
tgctcagggactcatctttct

SEQ ID NO: 276 - RNA, 21 nt, synthetic construct
  misc_feature 1..21: note = Synthetic
  source 1..21: mol_type = other RNA
tggagtcaacactttcgattt

SEQ ID NO: 277 - RNA, 21 nt, synthetic construct
  misc_feature 1..21: note = Synthetic
  source 1..21: mol_type = other RNA
tggcctactacctggcctggt

SEQ ID NO: 278 - RNA, 21 nt, synthetic construct
  misc_feature 1..21: note = Synthetic
  source 1..21: mol_type = other RNA
ttcgatgacccgcgtcgttgt

SEQ ID NO: 279 - RNA, 21 nt, synthetic construct
  misc_feature 1..21: note = Synthetic
  source 1..21: mol_type = other RNA
ttgagcctcagcttctccggt

SEQ ID NO: 280 - RNA, 21 nt, synthetic construct
  misc_feature 1..21: note = Synthetic
  source 1..21: mol_type = other RNA
actcaataaagtgctttgaaa

SEQ ID NO: 281 - RNA, 21 nt, synthetic construct
  misc_feature 1..21: note = Synthetic
  source 1..21: mol_type = other RNA
tcaataaagtgctttgaaaat

SEQ ID NO: 282 - RNA, 21 nt, synthetic construct
  misc_feature 1..21: note = Synthetic
  source 1..21: mol_type = other RNA
ctcaataaagtgctttgaaaa

SEQ ID NO: 283 - RNA, 21 nt, synthetic construct
  misc_feature 1..21: note = Synthetic
  source 1..21: mol_type = other RNA
gaactcaataaagtgctttga

SEQ ID NO: 284 - RNA, 21 nt, synthetic construct
  misc_feature 1..21: note = Synthetic
  source 1..21: mol_type = other RNA
aataaagtgctttgaaaacgt

SEQ ID NO: 285 - RNA, 23 nt, synthetic construct
  modified_base 5: mod_base = OTHER; note = thymine
  misc_feature 1..23: note = Synthetic
  source 1..23: mol_type = other RNA
aggctcaaagcacttctctttct

SEQ ID NO: 286 - RNA, 23 nt, synthetic construct
  misc_feature 1..23: note = Synthetic
  source 1..23: mol_type = other RNA
acggcccttgtgggtacatttgt

SEQ ID NO: 287 - RNA, 23 nt, synthetic construct
  modified_base 12: mod_base = OTHER; note = thymine
  misc_feature 1..23: note = Synthetic
  source 1..23: mol_type = other RNA
acggatgtcgttgtccgggttcc

SEQ ID NO: 288 - RNA, 23 nt, synthetic construct
  modified_base 2: mod_base = OTHER; note = thymine
  modified_base 12: mod_base = OTHER; note = thymine
  misc_feature 1..23: note = Synthetic
  source 1..23: mol_type = other RNA
atcaaagcactttattgagttcc

SEQ ID NO: 289 - RNA, 23 nt, synthetic construct
  modified_base 12: mod_base = OTHER; note = thymine
  misc_feature 1..23: note = Synthetic
  source 1..23: mol_type = other RNA
accacagctgcttgctcagttct

SEQ ID NO: 290 - RNA, 23 nt, synthetic construct
  modified_base 5: mod_base = OTHER; note = thymine
  modified_base 12: mod_base = OTHER; note = thymine
  misc_feature 1..23: note = Synthetic
  source 1..23: mol_type = other RNA
actataccatatctcattcttgt

SEQ ID NO: 291 - RNA, 23 nt, synthetic construct
  misc_feature 1..23: note = Synthetic
  source 1..23: mol_type = other RNA
agagaacgactgtgtgctcttca

SEQ ID NO: 292 - RNA, 23 nt, synthetic construct
  modified_base 5: mod_base = OTHER; note = thymine
  modified_base 7: mod_base = OTHER; note = thymine
  misc_feature 1..23: note = Synthetic
  source 1..23: mol_type = other RNA
agcatctggccacagctgcttgc

SEQ ID NO: 293 - RNA, 23 nt, synthetic construct
  misc_feature 1..23: note = Synthetic
  source 1..23: mol_type = other RNA
acgcggccatcatagcagcttgc

SEQ ID NO: 294 - RNA, 23 nt, synthetic construct
  modified_base 5: mod_base = OTHER; note = thymine
  modified_base 7: mod_base = OTHER; note = thymine
  misc_feature 1..23: note = Synthetic
  source 1..23: mol_type = other RNA
atgctcttcagctttgtacttat

SEQ ID NO: 295 - RNA, 23 nt, synthetic construct
  modified_base 5: mod_base = OTHER; note = thymine
  misc_feature 1..23: note = Synthetic
  source 1..23: mol_type = other RNA
aagctgaggctcaaagcacttct

SEQ ID NO: 296 - RNA, 23 nt, synthetic construct
  modified_base 5: mod_base = OTHER; note = thymine
  modified_base 7: mod_base = OTHER; note = thymine
  misc_feature 1..23: note = Synthetic
  source 1..23: mol_type = other RNA
acattttcaaagcactttattga

SEQ ID NO: 297 - RNA, 23 nt, synthetic construct
  modified_base 7: mod_base = OTHER; note = thymine
  misc_feature 1..23: note = Synthetic
  source 1..23: mol_type = other RNA
agcccttgtgggtacatttgtgg

SEQ ID NO: 298 - RNA, 23 nt, synthetic construct
  modified_base 7: mod_base = OTHER; note = thymine
  misc_feature 1..23: note = Synthetic
  source 1..23: mol_type = other RNA
agacagtgagaacgactgtgtgc

SEQ ID NO: 299 - RNA, 23 nt, synthetic construct
  misc_feature 1..23: note = Synthetic
  source 1..23: mol_type = other RNA
agtagtaggccacatcggtgtag

SEQ ID NO: 300 - RNA, 23 nt, synthetic construct
  modified_base 7: mod_base = OTHER; note = thymine
  modified_base 12: mod_base = OTHER; note = thymine
  misc_feature 1..23: note = Synthetic
  source 1..23: mol_type = other RNA
acaaggtggaatcgaaagtgttg

SEQ ID NO: 301 - RNA, 23 nt, synthetic construct
  modified_base 7: mod_base = OTHER; note = thymine
  misc_feature 1..23: note = Synthetic
  source 1..23: mol_type = other RNA
acaaggtggaatcgaaagtgttg

SEQ ID NO: 302 - RNA, 23 nt, synthetic construct
  misc_feature 1..23: note = Synthetic
  source 1..23: mol_type = other RNA
agtgacagtgagaacgactgtgt

SEQ ID NO: 303 - RNA, 23 nt, synthetic construct
  misc_feature 1..23: note = Synthetic
  source 1..23: mol_type = other RNA
accagtacagcgcggcgatgtag

SEQ ID NO: 304 - RNA, 23 nt, synthetic construct
  modified_base 12: mod_base = OTHER; note = thymine
  misc_feature 1..23: note = Synthetic
  source 1..23: mol_type = other RNA
acagagccaggtcgtgctggtag

SEQ ID NO: 305 - RNA, 23 nt, synthetic construct
  modified_base 7: mod_base = OTHER; note = thymine
  misc_feature 1..23: note = Synthetic
  source 1..23: mol_type = other RNA
agcggatgtcgttgtccgggttc

SEQ ID NO: 306 - RNA, 23 nt, synthetic construct
  misc_feature 1..23: note = Synthetic
  source 1..23: mol_type = other RNA
actgatgatgccttgcagggtga

SEQ ID NO: 307 - RNA, 23 nt, synthetic construct
  modified_base 12: mod_base = OTHER; note = thymine
  misc_feature 1..23: note = Synthetic
  source 1..23: mol_type = other RNA
agacgcctggcttgttgcggtca

SEQ ID NO: 308 - RNA, 23 nt, synthetic construct
  misc_feature 1..23: note = Synthetic
  source 1..23: mol_type = other RNA
aaaggcgcaacagagccaggtcg

SEQ ID NO: 309 - RNA, 23 nt, synthetic construct
  misc_feature 1..23: note = Synthetic
  source 1..23: mol_type = other RNA
acaggcacaccggctgaacgtaa

SEQ ID NO: 310 - RNA, 23 nt, synthetic construct
  modified_base 7: mod_base = OTHER; note = thymine
  misc_feature 1..23: note = Synthetic
  source 1..23: mol_type = other RNA
accggatccaggccaggtagtag

SEQ ID NO: 311 - RNA, 23 nt, synthetic construct
  modified_base 2: mod_base = OTHER; note = thymine
  modified_base 12: mod_base = OTHER; note = thymine
  misc_feature 1..23: note = Synthetic
  source 1..23: mol_type = other RNA
attcaaagcactttattgagttc

SEQ ID NO: 312 - RNA, 23 nt, synthetic construct
  misc_feature 1..23: note = Synthetic
  source 1..23: mol_type = other RNA
agccacagctgcttgctcagttc

SEQ ID NO: 313 - RNA, 23 nt, synthetic construct
  modified_base 7: mod_base = OTHER; note = thymine
  misc_feature 1..23: note = Synthetic
  source 1..23: mol_type = other RNA
agaggctcaaagcacttctcttt

SEQ ID NO: 314 - RNA, 23 nt, synthetic construct
  misc_feature 1..23: note = Synthetic
  source 1..23: mol_type = other RNA
atgagaacgactgtgtgctcttc

SEQ ID NO: 315 - RNA, 23 nt, synthetic construct
  modified_base 7: mod_base = OTHER; note = thymine
  misc_feature 1..23: note = Synthetic
  source 1..23: mol_type = other RNA
aggtcatcgaagacagactcttg

SEQ ID NO: 316 - RNA, 23 nt, synthetic construct
  misc_feature 1..23: note = Synthetic
  source 1..23: mol_type = other RNA
aggacccttgcactggcatctgg

SEQ ID NO: 317 - RNA, 23 nt, synthetic construct
  misc_feature 1..23: note = Synthetic
  source 1..23: mol_type = other RNA
acaacagagccaggtcgtgctgg

SEQ ID NO: 318 - RNA, 23 nt, synthetic construct
  modified_base 7: mod_base = OTHER; note = thymine
  misc_feature 1..23: note = Synthetic
  source 1..23: mol_type = other RNA
aatcggtgtagacgcctggcttg

SEQ ID NO: 319 - RNA, 23 nt, synthetic construct
  modified_base 7: mod_base = OTHER; note = thymine
  misc_feature 1..23: note = Synthetic
  source 1..23: mol_type = other RNA
aatcggtgtagacgcctggcttg

SEQ ID NO: 320 - RNA, 23 nt, synthetic construct
  modified_base 5: mod_base = OTHER; note = thymine
  modified_base 7: mod_base = OTHER; note = thymine
  misc_feature 1..23: note = Synthetic
  source 1..23: mol_type = other RNA
agtctttcactttcttgggctcc

SEQ ID NO: 321 - RNA, 23 nt, synthetic construct
  misc_feature 1..23: note = Synthetic
  source 1..23: mol_type = other RNA
acgactgtgtgctcttcagcttt

SEQ ID NO: 322 - RNA, 23 nt, synthetic construct
  misc_feature 1..23: note = Synthetic
  source 1..23: mol_type = other RNA
accgcggccatcatagcagcttg

SEQ ID NO: 323 - RNA, 23 nt, synthetic construct
  misc_feature 1..23: note = Synthetic
  source 1..23: mol_type = other RNA
aggtacatttgtggtacagctgc

SEQ ID NO: 324 - RNA, 23 nt, synthetic construct
  modified_base 5: mod_base = OTHER; note = thymine
  modified_base 7: mod_base = OTHER; note = thymine
  modified_base 12: mod_base = OTHER; note = thymine
  misc_feature 1..23: note = Synthetic
  source 1..23: mol_type = other RNA
aagctttgtacttatgctccttg

SEQ ID NO: 325 - RNA, 23 nt, synthetic construct
  modified_base 5: mod_base = OTHER; note = thymine
  modified_base 7: mod_base = OTHER; note = thymine
  misc_feature 1..23: note = Synthetic
  source 1..23: mol_type = other RNA
aagctttgtacttatgctccttg

SEQ ID NO: 326 - RNA, 23 nt, synthetic construct
  modified_base 7: mod_base = OTHER; note = thymine
  misc_feature 1..23: note = Synthetic
  source 1..23: mol_type = other RNA
attgagttcctgcgccatcctgg

SEQ ID NO: 327 - RNA, 23 nt, synthetic construct
  modified_base 7: mod_base = OTHER; note = thymine
  misc_feature 1..23: note = Synthetic
  source 1..23: mol_type = other RNA
accacatcggtgtagacgcctgg

SEQ ID NO: 328 - RNA, 23 nt, synthetic construct
  modified_base 7: mod_base = OTHER; note = thymine
  misc_feature 1..23: note = Synthetic
  source 1..23: mol_type = other RNA
aatgagtgggacatgaagcctag

SEQ ID NO: 329 - RNA, 23 nt, synthetic construct
  modified_base 2: mod_base = OTHER; note = thymine
  modified_base 7: mod_base = OTHER; note = thymine
  misc_feature 1..23: note = Synthetic
  source 1..23: mol_type = other RNA
atggaatcgaaagtgttgactcc

SEQ ID NO: 330 - RNA, 23 nt, synthetic construct
  modified_base 7: mod_base = OTHER; note = thymine
  misc_feature 1..23: note = Synthetic
  source 1..23: mol_type = other RNA
atggaatcgaaagtgttgactcc

SEQ ID NO: 331 - RNA, 23 nt, synthetic construct
  modified_base 5: mod_base = OTHER; note = thymine
  modified_base 7: mod_base = OTHER; note = thymine
  misc_feature 1..23: note = Synthetic
  source 1..23: mol_type = other RNA
agcattttcaaagcactttattg

SEQ ID NO: 332 - RNA, 23 nt, synthetic construct
  misc_feature 1..23: note = Synthetic
  source 1..23: mol_type = other RNA
aacgaagcaccacgggcggatgt

SEQ ID NO: 333 - RNA, 23 nt, synthetic construct
  modified_base 7: mod_base = OTHER; note = thymine
  misc_feature 1..23: note = Synthetic
  source 1..23: mol_type = other RNA
atgcggtcaccacagcccgatcc

SEQ ID NO: 334 - RNA, 23 nt, synthetic construct
  misc_feature 1..23: note = Synthetic
  source 1..23: mol_type = other RNA
acaggacccttgcactggcatct

SEQ ID NO: 335 - RNA, 23 nt, synthetic construct
  misc_feature 1..23: note = Synthetic
  source 1..23: mol_type = other RNA
aaggaaccctgcgcagagcatgc

SEQ ID NO: 336 - RNA, 23 nt, synthetic construct
  misc_feature 1..23: note = Synthetic
  source 1..23: mol_type = other RNA
agccggcccttgtgggtacattt

SEQ ID NO: 337 - RNA, 23 nt, synthetic construct
  misc_feature 1..23: note = Synthetic
  source 1..23: mol_type = other RNA
aaagatgagtccctgagcaatca

SEQ ID NO: 338 - RNA, 23 nt, synthetic construct
  modified_base 5: mod_base = OTHER; note = thymine
  modified_base 7: mod_base = OTHER; note = thymine
  misc_feature 1..23: note = Synthetic
  source 1..23: mol_type = other RNA
actgtgtgctcttcagctttgta

SEQ ID NO: 339 - RNA, 23 nt, synthetic construct
  modified_base 7: mod_base = OTHER; note = thymine
  misc_feature 1..23: note = Synthetic
  source 1..23: mol_type = other RNA
aggcccttgtgggtacatttgtg

SEQ ID NO: 340 - RNA, 23 nt, synthetic construct
  modified_base 7: mod_base = OTHER; note = thymine
  misc_feature 1..23: note = Synthetic
  source 1..23: mol_type = other RNA
aagtggtctttcactttcttggg

SEQ ID NO: 341 - RNA, 23 nt, synthetic construct
  modified_base 2: mod_base = OTHER; note = thymine
  modified_base 5: mod_base = OTHER; note = thymine
  misc_feature 1..23: note = Synthetic
  source 1..23: mol_type = other RNA
atcatcgaagacagactcttgcg

SEQ ID NO: 342 - RNA, 23 nt, synthetic construct
  modified_base 5: mod_base = OTHER; note = thymine
  modified_base 7: mod_base = OTHER; note = thymine
  misc_feature 1..23: note = Synthetic
  source 1..23: mol_type = other RNA
actttgtacttatgctccttggg

SEQ ID NO: 343 - RNA, 23 nt, synthetic construct
  modified_base 5: mod_base = OTHER; note = thymine
  modified_base 12: mod_base = OTHER; note = thymine
  misc_feature 1..23: note = Synthetic
  source 1..23: mol_type = other RNA
acccttgtgggtacatttgtggt

SEQ ID NO: 344 - RNA, 23 nt, synthetic construct
  modified_base 5: mod_base = OTHER; note = thymine
  misc_feature 1..23: note = Synthetic
  source 1..23: mol_type = other RNA
atgatgatgccttgcagggtgag

SEQ ID NO: 345 - RNA, 23 nt, synthetic construct
  modified_base 7: mod_base = OTHER; note = thymine
  misc_feature 1..23: note = Synthetic
  source 1..23: mol_type = other RNA
aggtagtaggccacatcggtgta

SEQ ID NO: 346 - RNA, 23 nt, synthetic construct
  misc_feature 1..23: note = Synthetic
  source 1..23: mol_type = other RNA
acgcaacagagccaggtcgtgct

SEQ ID NO: 347 - RNA, 23 nt, synthetic construct
  modified_base 5: mod_base = OTHER; note = thymine
  modified_base 7: mod_base = OTHER; note = thymine
  misc_feature 1..23: note = Synthetic
  source 1..23: mol_type = other RNA
atgttgtggacagagacagtggg

SEQ ID NO: 348 - RNA, 23 nt, synthetic construct
  misc_feature 1..23: note = Synthetic
  source 1..23: mol_type = other RNA
accaaggtggaatcgaaagtgtt

SEQ ID NO: 349 - RNA, 23 nt, synthetic construct
  modified_base 7: mod_base = OTHER; note = thymine
  misc_feature 1..23: note = Synthetic
  source 1..23: mol_type = other RNA
agacccttgcactggcatctggc

SEQ ID NO: 350 - RNA, 23 nt, synthetic construct
  misc_feature 1..23: note = Synthetic
  source 1..23: mol_type = other RNA
aaacagagccaggtcgtgctggt

SEQ ID NO: 351 - RNA, 23 nt, synthetic construct
  modified_base 7: mod_base = OTHER; note = thymine
  misc_feature 1..23: note = Synthetic
  source 1..23: mol_type = other RNA
agtacatttgtggtacagctgcc

SEQ ID NO: 352 - RNA, 23 nt, synthetic construct
  misc_feature 1..23: note = Synthetic
  source 1..23: mol_type = other RNA
actggcatctggccacagctgct

SEQ ID NO: 353 - RNA, 23 nt, synthetic construct
  modified_base 7: mod_base = OTHER; note = thymine
  misc_feature 1..23: note = Synthetic
  source 1..23: mol_type = other RNA
aagcactttattgagttcctgcg

SEQ ID NO: 354 - RNA, 23 nt, synthetic construct
  modified_base 7: mod_base = OTHER; note = thymine
  misc_feature 1..23: note = Synthetic
  source 1..23: mol_type = other RNA
atgagttcctgcgccatcctggc

SEQ ID NO: 355 - RNA, 23 nt, synthetic construct
  modified_base 12: mod_base = OTHER; note = thymine
  misc_feature 1..23: note = Synthetic
  source 1..23: mol_type = other RNA
acacatcggtgtagacgcctggc

SEQ ID NO: 356 - RNA, 23 nt, synthetic construct
  modified_base 12: mod_base = OTHER; note = thymine
  misc_feature 1..23: note = Synthetic
  source 1..23: mol_type = other RNA
agagggaaagatgagtccctgag

SEQ ID NO: 357 - RNA, 23 nt, synthetic construct
  modified_base 5: mod_base = OTHER; note = thymine
  misc_feature 1..23: note = Synthetic
  source 1..23: mol_type = other RNA
agcatcaggacccttgcactggc

SEQ ID NO: 358 - RNA, 23 nt, synthetic construct
  modified_base 5: mod_base = OTHER; note = thymine
  modified_base 7: mod_base = OTHER; note = thymine
  misc_feature 1..23: note = Synthetic
  source 1..23: mol_type = other RNA
accttgtgggtacatttgtggta

SEQ ID NO: 359 - RNA, 23 nt, synthetic construct
  modified_base 5: mod_base = OTHER; note = thymine
  modified_base 7: mod_base = OTHER; note = thymine
  misc_feature 1..23: note = Synthetic
  source 1..23: mol_type = other RNA
accttgtgggtacatttgtggta

SEQ ID NO: 360 - RNA, 23 nt, synthetic construct
  modified_base 7: mod_base = OTHER; note = thymine
  modified_base 12: mod_base = OTHER; note = thymine
  misc_feature 1..23: note = Synthetic
  source 1..23: mol_type = other RNA
aacccttgcactggcatctggcc

SEQ ID NO: 361 - RNA, 23 nt, synthetic construct
  modified_base 5: mod_base = OTHER; note = thymine
  misc_feature 1..23: note = Synthetic
  source 1..23: mol_type = other RNA
aacatcggtgtagacgcctggct

SEQ ID NO: 362 - RNA, 23 nt, synthetic construct
  modified_base 5: mod_base = OTHER; note = thymine
  modified_base 7: mod_base = OTHER; note = thymine
  misc_feature 1..23: note = Synthetic
  source 1..23: mol_type = other RNA
atggtctttcactttcttgggct

SEQ ID NO: 363 - RNA, 23 nt, synthetic construct
  misc_feature 1..23: note = Synthetic
  source 1..23: mol_type = other RNA
aggcggatgtcgttgtccgggtt

SEQ ID NO: 364 - RNA, 23 nt, synthetic construct
  misc_feature 1..23: note = Synthetic
  source 1..23: mol_type = other RNA
aggcggatgtcgttgtccgggtt

SEQ ID NO: 365 - RNA, 23 nt, synthetic construct
  modified_base 7: mod_base = OTHER; note = thymine
  misc_feature 1..23: note = Synthetic
  source 1..23: mol_type = other RNA
agctgatgatgccttgcagggtg

SEQ ID NO: 366 - RNA, 23 nt, synthetic construct
  misc_feature 1..23: note = Synthetic
  source 1..23: mol_type = other RNA
acaggtagtaggccacatcggtg

SEQ ID NO: 367 - RNA, 23 nt, synthetic construct
  misc_feature 1..23: note = Synthetic
  source 1..23: mol_type = other RNA
aagacgcctggcttgttgcggtc

SEQ ID NO: 368 - RNA, 23 nt, synthetic construct
  modified_base 2: mod_base = OTHER; note = thymine
  misc_feature 1..23: note = Synthetic
  source 1..23: mol_type = other RNA
atcgaagacagactcttgcggag

SEQ ID NO: 369 - RNA, 23 nt, synthetic construct
  modified_base 2: mod_base = OTHER; note = thymine
  modified_base 7: mod_base = OTHER; note = thymine
  misc_feature 1..23: note = Synthetic
  source 1..23: mol_type = other RNA
atgtcgttgtccgggttccggca

SEQ ID NO: 370 - RNA, 23 nt, synthetic construct
  modified_base 7: mod_base = OTHER; note = thymine
  misc_feature 1..23: note = Synthetic
  source 1..23: mol_type = other RNA
atgtcgttgtccgggttccggca

SEQ ID NO: 371 - RNA, 23 nt, synthetic construct
  modified_base 7: mod_base = OTHER; note = thymine
  misc_feature 1..23: note = Synthetic
  source 1..23: mol_type = other RNA
agtacctgcgcctcctgcaggaa

SEQ ID NO: 372 - RNA, 23 nt, synthetic construct
  misc_feature 1..23: note = Synthetic
  source 1..23: mol_type = other RNA
agctgaacgtaaggcgacaggag

SEQ ID NO: 373 - RNA, 23 nt, synthetic construct
  misc_feature 1..23: note = Synthetic
  source 1..23: mol_type = other RNA
agctgaacgtaaggcgacaggag

SEQ ID NO: 374 - RNA, 23 nt, synthetic construct
  misc_feature 1..23: note = Synthetic
  source 1..23: mol_type = other RNA
acacaccggctgaacgtaaggcg

SEQ ID NO: 375 - RNA, 23 nt, synthetic construct
  modified_base 2: mod_base = OTHER; note = thymine
  misc_feature 1..23: note = Synthetic
  source 1..23: mol_type = other RNA
atagacgcctggcttgttgcggt

SEQ ID NO: 376 - RNA, 23 nt, synthetic construct
  modified_base 5: mod_base = OTHER; note = thymine
  modified_base 7: mod_base = OTHER; note = thymine
  misc_feature 1..23: note = Synthetic
  source 1..23: mol_type = other RNA
acactttattgagttcctgcgcc

SEQ ID NO: 377 - RNA, 23 nt, synthetic construct
  misc_feature 1..23: note = Synthetic
  source 1..23: mol_type = other RNA
acaccggctgaacgtaaggcgac

SEQ ID NO: 378 - RNA, 23 nt, synthetic construct
  misc_feature 1..23: note = Synthetic
  source 1..23: mol_type = other RNA
aaacgtaaggcgacaggagcgcg

SEQ ID NO: 379 - RNA, 23 nt, synthetic construct
  modified_base 5: mod_base = OTHER; note = thymine
  misc_feature 1..23: note = Synthetic
  source 1..23: mol_type = other RNA
aatgtcgttgtccgggttccggc

SEQ ID NO: 380 - RNA, 23 nt, synthetic construct
  misc_feature 1..23: note = Synthetic
  source 1..23: mol_type = other RNA
agacagactcttgcggagccgct

SEQ ID NO: 381 - RNA, 23 nt, synthetic construct
  misc_feature 1..23: note = Synthetic
  source 1..23: mol_type = other RNA
aaggccacatcggtgtagacgcc

SEQ ID NO: 382 - RNA, 23 nt, synthetic construct
  modified_base 2: mod_base = OTHER; note = thymine
  misc_feature 1..23: note = Synthetic
  source 1..23: mol_type = other RNA
atccggaatcaccctggcacgca

SEQ ID NO: 383 - RNA, 23 nt, synthetic construct
  misc_feature 1..23: note = Synthetic
  source 1..23: mol_type = other RNA
aagtacagcgcggcgatgtaggg

SEQ ID NO: 384 - RNA, 23 nt, synthetic construct
  misc_feature 1..23: note = Synthetic
  source 1..23: mol_type = other RNA
acccggatccaggccaggtagta

SEQ ID NO: 385 - RNA, 23 nt, synthetic construct
  modified_base 2: mod_base = OTHER; note = thymine
  misc_feature 1..23: note = Synthetic
  source 1..23: mol_type = other RNA
atttcaaagcactttattgagtt

SEQ ID NO: 386 - RNA, 23 nt, synthetic construct
  misc_feature 1..23: note = Synthetic
  source 1..23: mol_type = other RNA
atttcaaagcactttattgagtt

SEQ ID NO: 387 - RNA, 23 nt, synthetic construct
  misc_feature 1..23: note = Synthetic
  source 1..23: mol_type = other RNA
agggaaagatgagtccctgagca

SEQ ID NO: 388 - RNA, 23 nt, synthetic construct
  modified_base 2: mod_base = OTHER; note = thymine
  misc_feature 1..23: note = Synthetic
  source 1..23: mol_type = other RNA
atgaacgtaaggcgacaggagcg

SEQ ID NO: 389 - RNA, 23 nt, synthetic construct
  misc_feature 1..23: note = Synthetic
  source 1..23: mol_type = other RNA
actcctgaaggcgcaacagagcc

SEQ ID NO: 390 - RNA, 23 nt, synthetic construct
  modified_base 12: mod_base = OTHER; note = thymine
  misc_feature 1..23: note = Synthetic
  source 1..23: mol_type = other RNA
aaacgactgtgtgctcttcagct

SEQ ID NO: 391 - RNA, 23 nt, synthetic construct
  modified_base 7: mod_base = OTHER; note = thymine
  misc_feature 1..23: note = Synthetic
  source 1..23: mol_type = other RNA
aatgagtccctgagcaatcagga

SEQ ID NO: 392 - RNA, 23 nt, synthetic construct
  modified_base 12: mod_base = OTHER; note = thymine
  misc_feature 1..23: note = Synthetic
  source 1..23: mol_type = other RNA
acagctgatgatgccttgcaggg

SEQ ID NO: 393 - RNA, 23 nt, synthetic construct
  modified_base 5: mod_base = OTHER; note = thymine
  modified_base 7: mod_base = OTHER; note = thymine
  misc_feature 1..23: note = Synthetic
  source 1..23: mol_type = other RNA
acgttgtccgggttccggcagaa

SEQ ID NO: 394 - RNA, 23 nt, synthetic construct
  misc_feature 1..23: note = Synthetic
  source 1..23: mol_type = other RNA
atgggtacatttgtggtacagct

SEQ ID NO: 395 - RNA, 23 nt, synthetic construct
  modified_base 5: mod_base = OTHER; note = thymine
  misc_feature 1..23: note = Synthetic
  source 1..23: mol_type = other RNA
aggctgaacgtaaggcgacagga

SEQ ID NO: 396 - RNA, 23 nt, synthetic construct
  modified_base 7: mod_base = OTHER; note = thymine
  misc_feature 1..23: note = Synthetic
  source 1..23: mol_type = other RNA
aggtgttgtggacagagacagtg

SEQ ID NO: 397 - RNA, 23 nt, synthetic construct
  modified_base 5: mod_base = OTHER; note = thymine
  modified_base 7: mod_base = OTHER; note = thymine
  misc_feature 1..23: note = Synthetic
  source 1..23: mol_type = other RNA
agcttgttgcggtcaccacagcc

SEQ ID NO: 398 - RNA, 23 nt, synthetic construct
  modified_base 12: mod_base = OTHER; note = thymine
  misc_feature 1..23: note = Synthetic
  source 1..23: mol_type = other RNA
agcacaccggctgaacgtaaggc

SEQ ID NO: 399 - RNA, 23 nt, synthetic construct
  misc_feature 1..23: note = Synthetic
  source 1..23: mol_type = other RNA
aaacgacgcgggtcatcgaagac

SEQ ID NO: 400 - RNA, 23 nt, synthetic construct
  modified_base 2: mod_base = OTHER; note = thymine
  modified_base 12: mod_base = OTHER; note = thymine
  misc_feature 1..23: note = Synthetic
  source 1..23: mol_type = other RNA
atcgaaagtgttgactccaagct

SEQ ID NO: 401 - RNA, 23 nt, synthetic construct
  misc_feature 1..23: note = Synthetic
  source 1..23: mol_type = other RNA
aggagaagctgaggctcaaagca

SEQ ID NO: 402 - RNA, 23 nt, synthetic construct
  modified_base 7: mod_base = OTHER; note = thymine
  misc_feature 1..23: note = Synthetic
  source 1..23: mol_type = other RNA
atgcagtggtctttcactttctt

SEQ ID NO: 403 - RNA, 23 nt, synthetic construct
  modified_base 5: mod_base = OTHER; note = thymine
  modified_base 7: mod_base = OTHER; note = thymine
  misc_feature 1..23: note = Synthetic
  source 1..23: mol_type = other RNA
aggatgtcgttgtccgggttccg

SEQ ID NO: 404 - RNA, 23 nt, synthetic construct
  modified_base 12: mod_base = OTHER; note = thymine
  misc_feature 1..23: note = Synthetic
  source 1..23: mol_type = other RNA
acaaagcactttattgagttcct

SEQ ID NO: 405 - RNA, 23 nt, synthetic construct
  modified_base 12: mod_base = OTHER; note = thymine
  misc_feature 1..23: note = Synthetic
  source 1..23: mol_type = other RNA
aagaacgactgtgtgctcttcag

SEQ ID NO: 406 - RNA, 23 nt, synthetic construct
  modified_base 7: mod_base = OTHER; note = thymine
  misc_feature 1..23: note = Synthetic
  source 1..23: mol_type = other RNA
aacgcctggcttgttgcggtcac

SEQ ID NO: 407 - RNA, 23 nt, synthetic construct
  misc_feature 1..23: note = Synthetic
  source 1..23: mol_type = other RNA
agtgagaacgactgtgtgctctt

SEQ ID NO: 408 - RNA, 23 nt, synthetic construct
  modified_base 7: mod_base = OTHER; note = thymine
  misc_feature 1..23: note = Synthetic
  source 1..23: mol_type = other RNA
atcagctttgtacttatgctcct

SEQ ID NO: 409 - RNA, 23 nt, synthetic construct
  misc_feature 1..23: note = Synthetic
  source 1..23: mol_type = other RNA
aaaccggagaagctgaggctcaa

SEQ ID NO: 410 - RNA, 23 nt, synthetic construct
  modified_base 5: mod_base = OTHER; note = thymine
  misc_feature 1..23: note = Synthetic
  source 1..23: mol_type = other RNA
agggtcatcgaagacagactctt

SEQ ID NO: 411 - RNA, 23 nt, synthetic construct
  misc_feature 1..23: note = Synthetic
  source 1..23: mol_type = other RNA
aaggacccttgcactggcatctg

SEQ ID NO: 412 - RNA, 23 nt, synthetic construct
  modified_base 5: mod_base = OTHER; note = thymine
  misc_feature 1..23: note = Synthetic
  source 1..23: mol_type = other RNA
atattgagttcctgcgccatcct

SEQ ID NO: 413 - RNA, 23 nt, synthetic construct
  modified_base 5: mod_base = OTHER; note = thymine
  misc_feature 1..23: note = Synthetic
  source 1..23: mol_type = other RNA
aagatgagtccctgagcaatcag

SEQ ID NO: 414 - RNA, 23 nt, synthetic construct
  misc_feature 1..23: note = Synthetic
  source 1..23: mol_type = other RNA
acatcgaagacagactcttgcgg

SEQ ID NO: 415 - RNA, 23 nt, synthetic construct
  modified_base 5: mod_base = OTHER; note = thymine
  misc_feature 1..23: note = Synthetic
  source 1..23: mol_type = other RNA
acagtgagaacgactgtgtgctc

SEQ ID NO: 416 - RNA, 23 nt, synthetic construct
  misc_feature 1..23: note = Synthetic
  source 1..23: mol_type = other RNA
agcaacagagccaggtcgtgctg

SEQ ID NO: 417 - RNA, 23 nt, synthetic construct
  misc_feature 1..23: note = Synthetic
  source 1..23: mol_type = other RNA
agcaacagagccaggtcgtgctg

SEQ ID NO: 418 - RNA, 23 nt, synthetic construct
  modified_base 7: mod_base = OTHER; note = thymine
  misc_feature 1..23: note = Synthetic
  source 1..23: mol_type = other RNA
atggcatctggccacagctgctt

SEQ ID NO: 419 - RNA, 23 nt, synthetic construct
  modified_base 7: mod_base = OTHER; note = thymine
  misc_feature 1..23: note = Synthetic
  source 1..23: mol_type = other RNA
agcactttattgagttcctgcgc

SEQ ID NO: 420 - RNA, 23 nt, synthetic construct
  modified_base 5: mod_base = OTHER; note = thymine
  misc_feature 1..23: note = Synthetic
  source 1..23: mol_type = other RNA
acccttgcactggcatctggcca

SEQ ID NO: 421 - RNA, 23 nt, synthetic construct
  misc_feature 1..23: note = Synthetic
  source 1..23: mol_type = other RNA
acatcggtgtagacgcctggctt

SEQ ID NO: 422 - RNA, 23 nt, synthetic construct
  modified_base 7: mod_base = OTHER; note = thymine
  misc_feature 1..23: note = Synthetic
  source 1..23: mol_type = other RNA
aggtctttcactttcttgggctc

SEQ ID NO: 423 - RNA, 23 nt, synthetic construct
  misc_feature 1..23: note = Synthetic
  source 1..23: mol_type = other RNA
aacaccggctgaacgtaaggcga

SEQ ID NO: 424 - RNA, 23 nt, synthetic construct
  modified_base 5: mod_base = OTHER; note = thymine
  misc_feature 1..23: note = Synthetic
  source 1..23: mol_type = other RNA
aactttattgagttcctgcgcca

SEQ ID NO: 425 - RNA, 23 nt, synthetic construct
  modified_base 7: mod_base = OTHER; note = thymine
  misc_feature 1..23: note = Synthetic
  source 1..23: mol_type = other RNA
accgcatcctcctgaaggcgcaa

SEQ ID NO: 426 - RNA, 23 nt, synthetic construct
  misc_feature 1..23: note = Synthetic
  source 1..23: mol_type = other RNA
aacagactcttgcggagccgctg

SEQ ID NO: 427 - RNA, 23 nt, synthetic construct
  misc_feature 1..23: note = Synthetic
  source 1..23: mol_type = other RNA
aggaaagatgagtccctgagcaa

SEQ ID NO: 428 - RNA, 23 nt, synthetic construct
  misc_feature 1..23: note = Synthetic
  source 1..23: mol_type = other RNA
aaagacagactcttgcggagccg

SEQ ID NO: 429 - RNA, 23 nt, synthetic construct
  modified_base 7: mod_base = OTHER; note = thymine
  misc_feature 1..23: note = Synthetic
  source 1..23: mol_type = other RNA
agaacgtaaggcgacaggagcgc

SEQ ID NO: 430 - RNA, 23 nt, synthetic construct
  modified_base 12: mod_base = OTHER; note = thymine
  misc_feature 1..23: note = Synthetic
  source 1..23: mol_type = other RNA
acgaggaaccctgcgcagagcat

SEQ ID NO: 431 - RNA, 23 nt, synthetic construct
  misc_feature 1..23: note = Synthetic
  source 1..23: mol_type = other RNA
acgaggaaccctgcgcagagcat

SEQ ID NO: 432 - RNA, 23 nt, synthetic construct
  modified_base 2: mod_base = OTHER; note = thymine
  modified_base 5: mod_base = OTHER; note = thymine
  misc_feature 1..23: note = Synthetic
  source 1..23: mol_type = other RNA
atcctgaaggcgcaacagagcca

SEQ ID NO: 433 - RNA, 23 nt, synthetic construct
  modified_base 5: mod_base = OTHER; note = thymine
  misc_feature 1..23: note = Synthetic
  source 1..23: mol_type = other RNA
atcctgaaggcgcaacagagcca

SEQ ID NO: 434 - RNA, 23 nt, synthetic construct
  modified_base 7: mod_base = OTHER; note = thymine
  misc_feature 1..23: note = Synthetic
  source 1..23: mol_type = other RNA
aacgactgtgtgctcttcagctt

SEQ ID NO: 435 - RNA, 23 nt, synthetic construct
  modified_base 12: mod_base = OTHER; note = thymine
  misc_feature 1..23: note = Synthetic
  source 1..23: mol_type = other RNA
acccgcggccatcatagcagctt

SEQ ID NO: 436 - RNA, 23 nt, synthetic construct
  modified_base 7: mod_base = OTHER; note = thymine
  misc_feature 1..23: note = Synthetic
  source 1..23: mol_type = other RNA
acttggtcctcacacaccagcgg

SEQ ID NO: 437 - RNA, 23 nt, synthetic construct
  modified_base 7: mod_base = OTHER; note = thymine
  modified_base 12: mod_base = OTHER; note = thymine
  misc_feature 1..23: note = Synthetic
  source 1..23: mol_type = other RNA
acttgttgcggtcaccacagccc

SEQ ID NO: 438 - RNA, 23 nt, synthetic construct
  modified_base 7: mod_base = OTHER; note = thymine
  misc_feature 1..23: note = Synthetic
  source 1..23: mol_type = other RNA
acttgttgcggtcaccacagccc

SEQ ID NO: 439 - RNA, 23 nt, synthetic construct
  modified_base 5: mod_base = OTHER; note = thymine
  misc_feature 1..23: note = Synthetic
  source 1..23: mol_type = other RNA
agcatgagtgggacatgaagcct

SEQ ID NO: 440 - RNA, 23 nt, synthetic construct
  misc_feature 1..23: note = Synthetic
  source 1..23: mol_type = other RNA
agagaagctgaggctcaaagcac

SEQ ID NO: 441 - RNA, 23 nt, synthetic construct
  misc_feature 1..23: note = Synthetic
  source 1..23: mol_type = other RNA
aaaagcactttattgagttcctg

SEQ ID NO: 442 - RNA, 23 nt, synthetic construct
  modified_base 7: mod_base = OTHER; note = thymine
  misc_feature 1..23: note = Synthetic
  source 1..23: mol_type = other RNA
acagctttgtacttatgctcctt

SEQ ID NO: 443 - RNA, 23 nt, synthetic construct
  modified_base 5: mod_base = OTHER; note = thymine
  misc_feature 1..23: note = Synthetic
  source 1..23: mol_type = other RNA
actttcactttcttgggctccaa

SEQ ID NO: 444 - RNA, 23 nt, synthetic construct
  modified_base 5: mod_base = OTHER; note = thymine
  modified_base 12: mod_base = OTHER; note = thymine
  misc_feature 1..23: note = Synthetic
  source 1..23: mol_type = other RNA
agaatcgaaagtgttgactccaa

SEQ ID NO: 445 - RNA, 23 nt, synthetic construct
  modified_base 12: mod_base = OTHER; note = thymine
  misc_feature 1..23: note = Synthetic
  source 1..23: mol_type = other RNA
agccacatcggtgtagacgcctg

SEQ ID NO: 446 - RNA, 23 nt, synthetic construct
  misc_feature 1..23: note = Synthetic
  source 1..23: mol_type = other RNA
agccacatcggtgtagacgcctg

SEQ ID NO: 447 - RNA, 23 nt, synthetic construct
  modified_base 12: mod_base = OTHER; note = thymine
  misc_feature 1..23: note = Synthetic
  source 1..23: mol_type = other RNA
aagacagactcttgcggagccgc

SEQ ID NO: 448 - RNA, 23 nt, synthetic construct
  misc_feature 1..23: note = Synthetic
  source 1..23: mol_type = other RNA
acctgaaggcgcaacagagccag

SEQ ID NO: 449 - RNA, 23 nt, synthetic construct
  modified_base 7: mod_base = OTHER; note = thymine
  misc_feature 1..23: note = Synthetic
  source 1..23: mol_type = other RNA
aggcagtgggcatcaggaccctt

SEQ ID NO: 450 - RNA, 23 nt, synthetic construct
  misc_feature 1..23: note = Synthetic
  source 1..23: mol_type = other RNA
agtggaatcgaaagtgttgactc

SEQ ID NO: 451 - RNA, 23 nt, synthetic construct
  misc_feature 1..23: note = Synthetic
  source 1..23: mol_type = other RNA
agtggaatcgaaagtgttgactc

SEQ ID NO: 452 - RNA, 23 nt, synthetic construct
  modified_base 7: mod_base = OTHER; note = thymine
  misc_feature 1..23: note = Synthetic
  source 1..23: mol_type = other RNA
accggctgaacgtaaggcgacag

SEQ ID NO: 453 - RNA, 23 nt, synthetic construct
  modified_base 7: mod_base = OTHER; note = thymine
  misc_feature 1..23: note = Synthetic
  source 1..23: mol_type = other RNA
accggctgaacgtaaggcgacag

SEQ ID NO: 454 - RNA, 23 nt, synthetic construct
  modified_base 12: mod_base = OTHER; note = thymine
  misc_feature 1..23: note = Synthetic
  source 1..23: mol_type = other RNA
accggtgacagtgagaacgactg

SEQ ID NO: 455 - RNA, 23 nt, synthetic construct
  modified_base 7: mod_base = OTHER; note = thymine
  misc_feature 1..23: note = Synthetic
  source 1..23: mol_type = other RNA
agcgggtcatcgaagacagactc

SEQ ID NO: 456 - RNA, 23 nt, synthetic construct
  misc_feature 1..23: note = Synthetic
  source 1..23: mol_type = other RNA
acgacgcgggtcatcgaagacag

SEQ ID NO: 457 - RNA, 23 nt, synthetic construct
  modified_base 7: mod_base = OTHER; note = thymine
  misc_feature 1..23: note = Synthetic
  source 1..23: mol_type = other RNA
agggcatcaggacccttgcactg

SEQ ID NO: 458 - RNA, 23 nt, synthetic construct
  modified_base 7: mod_base = OTHER; note = thymine
  misc_feature 1..23: note = Synthetic
  source 1..23: mol_type = other RNA
atggcttgttgcggtcaccacag

SEQ ID NO: 459 - RNA, 23 nt, synthetic construct
  modified_base 7: mod_base = OTHER; note = thymine
  misc_feature 1..23: note = Synthetic
  source 1..23: mol_type = other RNA
acatcctcctgaaggcgcaacag

SEQ ID NO: 460 - RNA, 23 nt, synthetic construct
  modified_base 7: mod_base = OTHER; note = thymine
  misc_feature 1..23: note = Synthetic
  source 1..23: mol_type = other RNA
acatcctcctgaaggcgcaacag

SEQ ID NO: 461 - RNA, 23 nt, synthetic construct
  modified_base 7: mod_base = OTHER; note = thymine
  modified_base 12: mod_base = OTHER; note = thymine
  misc_feature 1..23: note = Synthetic
  source 1..23: mol_type = other RNA
agctcttcagctttgtacttatg

SEQ ID NO: 462 - RNA, 23 nt, synthetic construct
  modified_base 7: mod_base = OTHER; note = thymine
  misc_feature 1..23: note = Synthetic
  source 1..23: mol_type = other RNA
agctcttcagctttgtacttatg

SEQ ID NO: 463 - RNA, 23 nt, synthetic construct
  modified_base 5: mod_base = OTHER; note = thymine
  misc_feature 1..23: note = Synthetic
  source 1..23: mol_type = other RNA
acagtacagcgcggcgatgtagg

SEQ ID NO: 464 - RNA, 23 nt, synthetic construct
  modified_base 2: mod_base = OTHER; note = thymine
  misc_feature 1..23: note = Synthetic
  source 1..23: mol_type = other RNA
atcccggatccaggccaggtagt

SEQ ID NO: 465 - RNA, 23 nt, synthetic construct
  misc_feature 1..23: note = Synthetic
  source 1..23: mol_type = other RNA
acggatccaggccaggtagtagg

SEQ ID NO: 466 - RNA, 23 nt, synthetic construct
  misc_feature 1..23: note = Synthetic
  source 1..23: mol_type = other RNA
aggtggaatcgaaagtgttgact

SEQ ID NO: 467 - RNA, 23 nt, synthetic construct
  modified_base 7: mod_base = OTHER; note = thymine
  misc_feature 1..23: note = Synthetic
  source 1..23: mol_type = other RNA
agatgatgccttgcagggtgagc

SEQ ID NO: 468 - RNA, 23 nt, synthetic construct
  misc_feature 1..23: note = Synthetic
  source 1..23: mol_type = other RNA
attggcaggcacaccggctgaac

SEQ ID NO: 469 - RNA, 23 nt, synthetic construct
  modified_base 7: mod_base = OTHER; note = thymine
  misc_feature 1..23: note = Synthetic
  source 1..23: mol_type = other RNA
atgccgtccgcatcctcctgaag

SEQ ID NO: 470 - RNA, 23 nt, synthetic construct
  misc_feature 1..23: note = Synthetic
  source 1..23: mol_type = other RNA
aagggaaagatgagtccctgagc

SEQ ID NO: 471 - RNA, 23 nt, synthetic construct
  misc_feature 1..23: note = Synthetic
  source 1..23: mol_type = other RNA
acgaagacagactcttgcggagc

SEQ ID NO: 472 - RNA, 23 nt, synthetic construct
  misc_feature 1..23: note = Synthetic
  source 1..23: mol_type = other RNA
actgaacgtaaggcgacaggagc

SEQ ID NO: 473 - RNA, 23 nt, synthetic construct
  misc_feature 1..23: note = Synthetic
  source 1..23: mol_type = other RNA
aaccggctgaacgtaaggcgaca

SEQ ID NO: 474 - RNA, 23 nt, synthetic construct
  modified_base 7: mod_base = OTHER; note = thymine
  misc_feature 1..23: note = Synthetic
  source 1..23: mol_type = other RNA
atgaggtgttgtggacagagaca

SEQ ID NO: 475 - RNA, 23 nt, synthetic construct
  modified_base 7: mod_base = OTHER; note = thymine
  misc_feature 1..23: note = Synthetic
  source 1..23: mol_type = other RNA
acctcctgaaggcgcaacagagc

SEQ ID NO: 476 - RNA, 23 nt, synthetic construct
  misc_feature 1..23: note = Synthetic
  source 1..23: mol_type = other RNA
agaacgactgtgtgctcttcagc

SEQ ID NO: 477 - RNA, 23 nt, synthetic construct
  misc_feature 1..23: note = Synthetic
  source 1..23: mol_type = other RNA
aaccggagaagctgaggctcaaa

SEQ ID NO: 478 - RNA, 23 nt, synthetic construct
  misc_feature 1..23: note = Synthetic
  source 1..23: mol_type = other RNA
agtcgcagtactcccagctcagc

SEQ ID NO: 479 - RNA, 23 nt, synthetic construct
  modified_base 5: mod_base = OTHER; note = thymine
  misc_feature 1..23: note = Synthetic
  source 1..23: mol_type = other RNA
aagctgagcccgcggccatcata

SEQ ID NO: 480 - RNA, 23 nt, synthetic construct
  modified_base 7: mod_base = OTHER; note = thymine
  misc_feature 1..23: note = Synthetic
  source 1..23: mol_type = other RNA
accagctgatgatgccttgcagg

SEQ ID NO: 481 - RNA, 23 nt, synthetic construct
  modified_base 7: mod_base = OTHER; note = thymine
  misc_feature 1..23: note = Synthetic
  source 1..23: mol_type = other RNA
accagctgatgatgccttgcagg

SEQ ID NO: 482 - RNA, 23 nt, synthetic construct
  misc_feature 1..23: note = Synthetic
  source 1..23: mol_type = other RNA
atgggcatcaggacccttgcact

SEQ ID NO: 483 - RNA, 23 nt, synthetic construct
  misc_feature 1..23: note = Synthetic
  source 1..23: mol_type = other RNA
atcaggacccttgcactggcatc

SEQ ID NO: 484 - RNA, 23 nt, synthetic construct
  misc_feature 1..23: note = Synthetic
  source 1..23: mol_type = other RNA
agcagcagagccctcatggcatc

SEQ ID NO: 485 - RNA, 23 nt, synthetic construct
  modified_base 12: mod_base = OTHER; note = thymine
  misc_feature 1..23: note = Synthetic
  source 1..23: mol_type = other RNA
acgcatcctcctgaaggcgcaac

SEQ ID NO: 486 - RNA, 23 nt, synthetic construct
  modified_base 12: mod_base = OTHER; note = thymine
  misc_feature 1..23: note = Synthetic
  source 1..23: mol_type = other RNA
agaaagatgagtccctgagcaat

SEQ ID NO: 487 - RNA, 23 nt, synthetic construct
  misc_feature 1..23: note = Synthetic
  source 1..23: mol_type = other RNA
agaaagatgagtccctgagcaat

SEQ ID NO: 488 - RNA, 23 nt, synthetic construct
  misc_feature 1..23: note = Synthetic
  source 1..23: mol_type = other RNA
aaatcgaaagtgttgactccaag

SEQ ID NO: 489 - RNA, 23 nt, synthetic construct
  misc_feature 1..23: note = Synthetic
  source 1..23: mol_type = other RNA
acttgcactggcatctggccaca

SEQ ID NO: 490 - RNA, 23 nt, synthetic construct
  modified_base 12: mod_base = OTHER; note = thymine
  misc_feature 1..23: note = Synthetic
  source 1..23: mol_type = other RNA
accaggccaggtagtaggccaca

SEQ ID NO: 491 - RNA, 23 nt, synthetic construct
  misc_feature 1..23: note = Synthetic
  source 1..23: mol_type = other RNA
actgaaggcgcaacagagccagg

SEQ ID NO: 492 - RNA, 23 nt, synthetic construct
  modified_base 7: mod_base = OTHER; note = thymine
  misc_feature 1..23: note = Synthetic
  source 1..23: mol_type = other RNA
actggcttgttgcggtcaccaca

SEQ ID NO: 493 - RNA, 23 nt, synthetic construct
  modified_base 7: mod_base = OTHER; note = thymine
  misc_feature 1..23: note = Synthetic
  source 1..23: mol_type = other RNA
agtgggtacatttgtggtacagc

SEQ ID NO: 494 - RNA, 23 nt, synthetic construct
  modified_base 5: mod_base = OTHER; note = thymine
  modified_base 7: mod_base = OTHER; note = thymine
  misc_feature 1..23: note = Synthetic
  source 1..23: mol_type = other RNA
aaggtgttgtggacagagacagt

SEQ ID NO: 495 - RNA, 23 nt, synthetic construct
  modified_base 7: mod_base = OTHER; note = thymine
  misc_feature 1..23: note = Synthetic
  source 1..23: mol_type = other RNA
atgcactggcatctggccacagc

SEQ ID NO: 496 - RNA, 23 nt, synthetic construct
  misc_feature 1..23: note = Synthetic
  source 1..23: mol_type = other RNA
aggcacaccggctgaacgtaagg

SEQ ID NO: 497 - RNA, 23 nt, synthetic construct
  modified_base 7: mod_base = OTHER; note = thymine
  misc_feature 1..23: note = Synthetic
  source 1..23: mol_type = other RNA
agggcatgagtgggacatgaagc

SEQ ID NO: 498 - RNA, 23 nt, synthetic construct
  misc_feature 1..23: note = Synthetic
  source 1..23: mol_type = other RNA
acaacgacgcgggtcatcgaaga

SEQ ID NO: 499 - RNA, 23 nt, synthetic construct
  modified_base 12: mod_base = OTHER; note = thymine
  misc_feature 1..23: note = Synthetic
  source 1..23: mol_type = other RNA
accggagaagctgaggctcaaag

SEQ ID NO: 500 - RNA, 23 nt, synthetic construct
  modified_base 7: mod_base = OTHER; note = thymine
  misc_feature 1..23: note = Synthetic
  source 1..23: mol_type = other RNA
attcactttcttgggctccaaac

SEQ ID NO: 501 - RNA, 23 nt, synthetic construct
  modified_base 12: mod_base = OTHER; note = thymine
  misc_feature 1..23: note = Synthetic
  source 1..23: mol_type = other RNA
aatcgaaagtgttgactccaagc

SEQ ID NO: 502 - RNA, 23 nt, synthetic construct
  misc_feature 1..23: note = Synthetic
  source 1..23: mol_type = other RNA
acggagaagctgaggctcaaagc

SEQ ID NO: 503 - RNA, 23 nt, synthetic construct
  misc_feature 1..23: note = Synthetic
  source 1..23: mol_type = other RNA
agagaacgactgtgtgctcttct

SEQ ID NO: 504 - RNA, 23 nt, synthetic construct
  modified_base 5: mod_base = OTHER; note = thymine
  modified_base 7: mod_base = OTHER; note = thymine
  misc_feature 1..23: note = Synthetic
  source 1..23: mol_type = other RNA
acattttcaaagcactttattct

SEQ ID NO: 505 - RNA, 23 nt, synthetic construct
  misc_feature 1..23: note = Synthetic
  source 1..23: mol_type = other RNA
accagtacagcgcggcgatgtct

SEQ ID NO: 506 - RNA, 23 nt, synthetic construct
  modified_base 12: mod_base = OTHER; note = thymine
  misc_feature 1..23: note = Synthetic
  source 1..23: mol_type = other RNA
acagagccaggtcgtgctggtct

SEQ ID NO: 507 - RNA, 23 nt, synthetic construct
  misc_feature 1..23: note = Synthetic
  source 1..23: mol_type = other RNA
actgatgatgccttgcagggtct

SEQ ID NO: 508 - RNA, 23 nt, synthetic construct
  modified_base 12: mod_base = OTHER; note = thymine
  misc_feature 1..23: note = Synthetic
  source 1..23: mol_type = other RNA
agacgcctggcttgttgcggtct

SEQ ID NO: 509 - RNA, 23 nt, synthetic construct
  modified_base 7: mod_base = OTHER; note = thymine
  misc_feature 1..23: note = Synthetic
  source 1..23: mol_type = other RNA
accggatccaggccaggtagtct

SEQ ID NO: 510 - RNA, 23 nt, synthetic construct
  misc_feature 1..23: note = Synthetic
  source 1..23: mol_type = other RNA
aaagatgagtccctgagcaatct

SEQ ID NO: 511 - RNA, 23 nt, synthetic construct
  modified_base 12: mod_base = OTHER; note = thymine
  misc_feature 1..23: note = Synthetic
  source 1..23: mol_type = other RNA
agagggaaagatgagtccctgct

SEQ ID NO: 512 - RNA, 23 nt, synthetic construct
  modified_base 5: mod_base = OTHER; note = thymine
  modified_base 7: mod_base = OTHER; note = thymine
  misc_feature 1..23: note = Synthetic
  source 1..23: mol_type = other RNA
accttgtgggtacatttgtggct

SEQ ID NO: 513 - RNA, 23 nt, synthetic construct
  modified_base 2: mod_base = OTHER; note = thymine
  misc_feature 1..23: note = Synthetic
  source 1..23: mol_type = other RNA
atcgaagacagactcttgcggct

SEQ ID NO: 514 - RNA, 23 nt, synthetic construct
  modified_base 2: mod_base = OTHER; note = thymine
  modified_base 7: mod_base = OTHER; note = thymine
  misc_feature 1..23: note = Synthetic
  source 1..23: mol_type = other RNA
atgtcgttgtccgggttccggct

SEQ ID NO: 515 - RNA, 23 nt, synthetic construct
  misc_feature 1..23: note = Synthetic
  source 1..23: mol_type = other RNA
agctgaacgtaaggcgacaggct

SEQ ID NO: 516 - RNA, 23 nt, synthetic construct
  misc_feature 1..23: note = Synthetic
  source 1..23: mol_type = other RNA
acaccggctgaacgtaaggcgct

SEQ ID NO: 517 - RNA, 23 nt, synthetic construct
  modified_base 2: mod_base = OTHER; note = thymine
  misc_feature 1..23: note = Synthetic
  source 1..23: mol_type = other RNA
atccggaatcaccctggcacgct

SEQ ID NO: 518 - RNA, 23 nt, synthetic construct
  misc_feature 1..23: note = Synthetic
  source 1..23: mol_type = other RNA
acccggatccaggccaggtagct

SEQ ID NO: 519 - RNA, 23 nt, synthetic construct
  misc_feature 1..23: note = Synthetic
  source 1..23: mol_type = other RNA
agggaaagatgagtccctgagct

SEQ ID NO: 520 - RNA, 23 nt, synthetic construct
  misc_feature 1..23: note = Synthetic
  source 1..23: mol_type = other RNA
aaacgacgcgggtcatcgaagct

SEQ ID NO: 521 - RNA, 23 nt, synthetic construct
  modified_base 12: mod_base = OTHER; note = thymine
  misc_feature 1..23: note = Synthetic
  source 1..23: mol_type = other RNA
aagaacgactgtgtgctcttcct

SEQ ID NO: 522 - RNA, 23 nt, synthetic construct
  misc_feature 1..23: note = Synthetic
  source 1..23: mol_type = other RNA
aaaccggagaagctgaggctcct

SEQ ID NO: 523 - RNA, 23 nt, synthetic construct
  modified_base 5: mod_base = OTHER; note = thymine
  misc_feature 1..23: note = Synthetic
  source 1..23: mol_type = other RNA
acccttgcactggcatctggcct

SEQ ID NO: 524 - RNA, 23 nt, synthetic construct
  misc_feature 1..23: note = Synthetic
  source 1..23: mol_type = other RNA
aacaccggctgaacgtaaggcct

SEQ ID NO: 525 - RNA, 23 nt, synthetic construct
  modified_base 5: mod_base = OTHER; note = thymine
  misc_feature 1..23: note = Synthetic
  source 1..23: mol_type = other RNA
aactttattgagttcctgcgcct

SEQ ID NO: 526 - RNA, 23 nt, synthetic construct
  modified_base 7: mod_base = OTHER; note = thymine
  misc_feature 1..23: note = Synthetic
  source 1..23: mol_type = other RNA
accgcatcctcctgaaggcgcct

SEQ ID NO: 527 - RNA, 23 nt, synthetic construct
  misc_feature 1..23: note = Synthetic
  source 1..23: mol_type = other RNA
aggaaagatgagtccctgagcct

SEQ ID NO: 528 - RNA, 23 nt, synthetic construct
  modified_base 12: mod_base = OTHER; note = thymine
  misc_feature 1..23: note = Synthetic
  source 1..23: mol_type = other RNA
acgaggaaccctgcgcagagcct

SEQ ID NO: 529 - RNA, 23 nt, synthetic construct
  modified_base 2: mod_base = OTHER; note = thymine
  modified_base 5: mod_base = OTHER; note = thymine
  misc_feature 1..23: note = Synthetic
  source 1..23: mol_type = other RNA
atcctgaaggcgcaacagagcct

SEQ ID NO: 530 - RNA, 23 nt, synthetic construct
  misc_feature 1..23: note = Synthetic
  source 1..23: mol_type = other RNA
agagaagctgaggctcaaagcct

SEQ ID NO: 531 - RNA, 23 nt, synthetic construct
  modified_base 5: mod_base = OTHER; note = thymine
  modified_base 12: mod_base = OTHER; note = thymine
  misc_feature 1..23: note = Synthetic
  source 1..23: mol_type = other RNA
agaatcgaaagtgttgactccct

SEQ ID NO: 532 - RNA, 23 nt, synthetic construct
  misc_feature 1..23: note = Synthetic
  source 1..23: mol_type = other RNA
acctgaaggcgcaacagagccct

SEQ ID NO: 533 - RNA, 23 nt, synthetic construct
  modified_base 7: mod_base = OTHER; note = thymine
  misc_feature 1..23: note = Synthetic
  source 1..23: mol_type = other RNA
accggctgaacgtaaggcgacct

SEQ ID NO: 534 - RNA, 23 nt, synthetic construct
  misc_feature 1..23: note = Synthetic
  source 1..23: mol_type = other RNA
acgacgcgggtcatcgaagacct

SEQ ID NO: 535 - RNA, 23 nt, synthetic construct
  modified_base 7: mod_base = OTHER; note = thymine
  misc_feature 1..23: note = Synthetic
  source 1..23: mol_type = other RNA
acatcctcctgaaggcgcaacct

SEQ ID NO: 536 - RNA, 23 nt, synthetic construct
  misc_feature 1..23: note = Synthetic
  source 1..23: mol_type = other RNA
aaccggctgaacgtaaggcgact

SEQ ID NO: 537 - RNA, 23 nt, synthetic construct
  misc_feature 1..23: note = Synthetic
  source 1..23: mol_type = other RNA
aaccggagaagctgaggctcact

SEQ ID NO: 538 - RNA, 23 nt, synthetic construct
  modified_base 12: mod_base = OTHER; note = thymine
  misc_feature 1..23: note = Synthetic
  source 1..23: mol_type = other RNA
acgcatcctcctgaaggcgcact

SEQ ID NO: 539 - RNA, 23 nt, synthetic construct
  modified_base 12: mod_base = OTHER; note = thymine
  misc_feature 1..23: note = Synthetic
  source 1..23: mol_type = other RNA
agaaagatgagtccctgagcact

SEQ ID NO: 540 - RNA, 23 nt, synthetic construct
  misc_feature 1..23: note = Synthetic
  source 1..23: mol_type = other RNA
aaatcgaaagtgttgactccact

SEQ ID NO: 541 - RNA, 23 nt, synthetic construct
  modified_base 12: mod_base = OTHER; note = thymine
  misc_feature 1..23: note = Synthetic
  source 1..23: mol_type = other RNA
accaggccaggtagtaggccact

SEQ ID NO: 542 - RNA, 23 nt, synthetic construct
  misc_feature 1..23: note = Synthetic
  source 1..23: mol_type = other RNA
acaacgacgcgggtcatcgaact

SEQ ID NO: 543 - RNA, 23 nt, synthetic construct
  modified_base 12: mod_base = OTHER; note = thymine
  misc_feature 1..23: note = Synthetic
  source 1..23: mol_type = other RNA
accggagaagctgaggctcaact

SEQ ID NO: 544 - RNA, 23 nt, synthetic construct
  misc_feature 1..23: note = Synthetic
  source 1..23: mol_type = other RNA
tttcaaagcactttattgagttc

SEQ ID NO: 545 - RNA, 23 nt, synthetic construct
  misc_feature 1..23: note = Synthetic
  source 1..23: mol_type = other RNA
attttcaaagcactttattgagt

SEQ ID NO: 546 - RNA, 23 nt, synthetic construct
  misc_feature 1..23: note = Synthetic
  source 1..23: mol_type = other RNA
ttttcaaagcactttattgagtt

SEQ ID NO: 547 - RNA, 23 nt, synthetic construct
  misc_feature 1..23: note = Synthetic
  source 1..23: mol_type = other RNA
tcaaagcactttattgagttcct

SEQ ID NO: 548 - RNA, 23 nt, synthetic construct
  misc_feature 1..23: note = Synthetic
  source 1..23: mol_type = other RNA
acgttttcaaagcactttattga

SEQ ID NO: 549 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
aaagagaagtgctttgagcct

SEQ ID NO: 550 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 9: mod_base = OTHER; note = 2'-fluorocytidine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
aaatgtacccacaagggccgt

SEQ ID NO: 551 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
aacccggacaacgacatccgt

SEQ ID NO: 552 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
aactcaataaagtgctttgat

SEQ ID NO: 553 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
aactgagcaagcagctgtggt

SEQ ID NO: 554 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 21: mod_base = OTHER; note = L96
  source 1..21: mol_type = other RNA
aagaatgagatatggtatagt

SEQ ID NO: 555 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
aagagcacacagtcgttctct

SEQ ID NO: 556 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
aagcagctgtggccagatgct

SEQ ID NO: 557 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
aagctgctatgatggccgcgt

SEQ ID NO: 558 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
aagtacaaagctgaagagcat

SEQ ID NO: 559 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
aagtgctttgagcctcagctt

SEQ ID NO: 560 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 21: mod_base = OTHER; note = L96
  source 1..21: mol_type = other RNA
aataaagtgctttgaaaatgt

SEQ ID NO: 561 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methylcytidine-3'- phosphorothioate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
acaaatgtacccacaagggct

SEQ ID NO: 562 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methylcytidine-3'- phosphorothioate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 21: mod_base = OTHER; note = L96
  source 1..21: mol_type = other RNA
acacagtcgttctcactgtct

SEQ ID NO: 563 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methylcytidine-3'- phosphorothioate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
acaccgatgtggcctactact

SEQ ID NO: 564 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methylcytidine-3'- phosphorothioate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 21: mod_base = OTHER; note = L96
  source 1..21: mol_type = other RNA
acactttcgattccaccttgt

SEQ ID NO: 565 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methylcytidine-3'- phosphorothioate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 21: mod_base = OTHER; note = L96
  source 1..21: mol_type = other RNA
acactttcgattccaccttgt

SEQ ID NO: 566 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methylcytidine-3'- phosphorothioate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 21: mod_base = OTHER; note = L96
  source 1..21: mol_type = other RNA
acagtcgttctcactgtcact

SEQ ID NO: 567 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methylcytidine-3'- phosphorothioate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
acatcgccgcgctgtactggt

SEQ ID NO: 568 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methylcytidine-3'- phosphorothioate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
accagcacgacctggctctgt

SEQ ID NO: 569 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methylcytidine-3'- phosphorothioate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
acccggacaacgacatccgct

SEQ ID NO: 570 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methylcytidine-3'- phosphorothioate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
accctgcaaggcatcatcagt

SEQ ID NO: 571 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methylcytidine-3'- phosphorothioate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
accgcaacaagccaggcgtct

SEQ ID NO: 572 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methylcytidine-3'- phosphorothioate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
acctggctctgttgcgccttt

SEQ ID NO: 573 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methylcytidine-3'- phosphorothioate
  modified_base 9: mod_base = OTHER; note = 2'-fluorocytidine-3'-phosphate
  modified_base 10: mod_base = OTHER; note = 2'-fluorocytidine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
acgttcagccggtgtgcctgt

SEQ ID NO: 574 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methylcytidine-3'- phosphorothioate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
actacctggcctggatccggt

SEQ ID NO: 575 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methylcytidine-3'- phosphorothioate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroguanine-3'-phosphate
  modified_base 21: mod_base = OTHER; note = L96
  source 1..21: mol_type = other RNA
actcaataaagtgctttgaat

SEQ ID NO: 576 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methylcytidine-3'- phosphorothioate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
actgagcaagcagctgtggct

SEQ ID NO: 577 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 21: mod_base = OTHER; note = L96
  source 1..21: mol_type = other RNA
agagaagtgctttgagcctct

SEQ ID NO: 578 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
agagcacacagtcgttctcat

SEQ ID NO: 579 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 21: mod_base = OTHER; note = L96
  source 1..21: mol_type = other RNA
agagtctgtcttcgatgacct

SEQ ID NO: 580 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
agatgccagtgcaagggtcct

SEQ ID NO: 581 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
agcacgacctggctctgttgt

SEQ ID NO: 582 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
agccaggcgtctacaccgatt

SEQ ID NO: 583 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
agccaggcgtctacaccgatt

SEQ ID NO: 584 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
agcccaagaaagtgaaagact

SEQ ID NO: 585 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
agctgaagagcacacagtcgt

SEQ ID NO: 586 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
agctgctatgatggccgcggt

SEQ ID NO: 587 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluoroguanosine-3'-cytidine
  modified_base 21: mod_base = OTHER; note = L96
  source 1..21: mol_type = other RNA
agctgtaccacaaatgtacct

SEQ ID NO: 588 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
aggagcataagtacaaagctt

SEQ ID NO: 589 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
aggagcataagtacaaagctt

SEQ ID NO: 590 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
aggatggcgcaggaactcaat

SEQ ID NO: 591 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
aggcgtctacaccgatgtggt

SEQ ID NO: 592 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 21: mod_base = OTHER; note = L96
  source 1..21: mol_type = other RNA
aggcttcatgtcccactcatt

SEQ ID NO: 593 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 21: mod_base = OTHER; note = L96
  source 1..21: mol_type = other RNA
agtcaacactttcgattccat

SEQ ID NO: 594 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 21: mod_base = OTHER; note = L96
  source 1..21: mol_type = other RNA
agtcaacactttcgattccat

SEQ ID NO: 595 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methyluridine-3'- phosphorothioate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 21: mod_base = OTHER; note = L96
  source 1..21: mol_type = other RNA
ataaagtgctttgaaaatgct

SEQ ID NO: 596 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methyluridine-3'- phosphorothioate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
atccgcccgtggtgcttcgtt

SEQ ID NO: 597 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methyluridine-3'- phosphorothioate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
atcgggctgtggtgaccgcat

SEQ ID NO: 598 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methyluridine-3'- phosphorothioate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
atgccagtgcaagggtcctgt

SEQ ID NO: 599 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methyluridine-3'- phosphorothioate
  modified_base 9: mod_base = OTHER; note = 2'-fluorocytidine-3'-phosphate
  modified_base 10: mod_base = OTHER; note = 2'-fluoroguanosine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
atgctctgcgcagggttcctt

SEQ ID NO: 600 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methyluridine-3'- phosphorothioate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
atgtacccacaagggccggct

SEQ ID NO: 601 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methyluridine-3'- phosphorothioate
  modified_base 9: mod_base = OTHER; note = 2'-fluoroguanosine-3'-phosphate
  modified_base 10: mod_base = OTHER; note = 2'-fluoroguanosine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
attgctcagggactcatcttt

SEQ ID NO: 602 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
caaagctgaagagcacacagt

SEQ ID NO: 603 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 9: mod_base = OTHER; note = 2'-fluorocytidine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
caaatgtacccacaagggcct

SEQ ID NO: 604 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
caagaaagtgaaagaccactt

SEQ ID NO: 605 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 21: mod_base = OTHER; note = L96
  source 1..21: mol_type = other RNA
caagagtctgtcttcgatgat

SEQ ID NO: 606 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
caaggagcataagtacaaagt

SEQ ID NO: 607 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 9: mod_base = OTHER; note = 2'-fluorouridine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
cacaaatgtacccacaagggt

SEQ ID NO: 608 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
caccctgcaaggcatcatcat

SEQ ID NO: 609 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
caccgatgtggcctactacct

SEQ ID NO: 610 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 9: mod_base = OTHER; note = 2'-fluoroguanosine-3'-phosphate
  modified_base 10: mod_base = OTHER; note = 2'-fluoroguanosine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
cacgacctggctctgttgcgt

SEQ ID NO: 611 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
cactgtctctgtccacaacat

SEQ ID NO: 612 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 21: mod_base = OTHER; note = L96
  source 1..21: mol_type = other RNA
cactttcgattccaccttggt

SEQ ID NO: 613 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 21: mod_base = OTHER; note = L96
  source 1..21: mol_type = other RNA
cagatgccagtgcaagggtct

SEQ ID NO: 614 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 9: mod_base = OTHER; note = 2'-fluorocytidine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 21: mod_base = OTHER; note = L96
  source 1..21: mol_type = other RNA
cagcacgacctggctctgttt

SEQ ID NO: 615 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 9: mod_base = OTHER; note = 2'-fluorocytidine-3'-phosphate
  modified_base 10: mod_base = OTHER; note = 2'-fluorocytidine-3'-phosphate
  modified_base 11: mod_base = OTHER; note = 2'-adenosine-3'-phosphate
  modified_base 21: mod_base = OTHER; note = L96
  source 1..21: mol_type = other RNA
cagctgtaccacaaatgtact

SEQ ID NO: 616 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
cagctgtggccagatgccagt

SEQ ID NO: 617 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-adenosine-3'-phosphate
  modified_base 21: mod_base = OTHER; note = L96
  source 1..21: mol_type = other RNA
caggaactcaataaagtgctt

SEQ ID NO: 618 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 9: mod_base = OTHER; note = 2'-fluorocytidine-3'-phosphate
  modified_base 10: mod_base = OTHER; note = 2'-fluoroguanosine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
caggatggcgcaggaactcat

SEQ ID NO: 619 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 9: mod_base = OTHER; note = 2'-fluorouridine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
caggcgtctacaccgatgtgt

SEQ ID NO: 620 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 21: mod_base = OTHER; note = L96
  source 1..21: mol_type = other RNA
cagggactcatctttccctct

SEQ ID NO: 621 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 9: mod_base = OTHER; note = 2'-fluoroguanosine-3'-phosphate
  modified_base 10: mod_base = OTHER; note = 2'-fluoroguanosine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
cagtgcaagggtcctgatgct

SEQ ID NO: 622 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methylcytidine-3'- phosphorothioate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
ccacaaatgtacccacaaggt

SEQ ID NO: 623 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methylcytidine-3'- phosphorothioate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
ccacaaatgtacccacaaggt

SEQ ID NO: 624 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methylcytidine-3'- phosphorothioate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
ccagatgccagtgcaagggtt

SEQ ID NO: 625 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methylcytidine-3'- phosphorothioate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
ccaggcgtctacaccgatgtt

SEQ ID NO: 626 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methylcytidine-3'- phosphorothioate
  modified_base 9: mod_base = OTHER; note = 2'-fluorocadenosine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 21: mod_base = OTHER; note = L96
  source 1..21: mol_type = other RNA
cccaagaaagtgaaagaccat

SEQ ID NO: 627 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methylcytidine-3'- phosphorothioate
  modified_base 9: mod_base = OTHER; note = 2'-fluorocadenosine-3'-phosphate
  modified_base 10: mod_base = OTHER; note = 2'-fluorocytidine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
cccggacaacgacatccgcct

SEQ ID NO: 628 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methylcytidine-3'- phosphorothioate
  modified_base 9: mod_base = OTHER; note = 2'-fluorocadenosine-3'-phosphate
  modified_base 10: mod_base = OTHER; note = 2'-fluorocytidine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
cccggacaacgacatccgcct

SEQ ID NO: 629 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methylcytidine-3'- phosphorothioate
  modified_base 9: mod_base = OTHER; note = 2'-fluoroguanosine-3'-phosphate
  modified_base 10: mod_base = OTHER; note = 2'-fluoroguanosine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
ccctgcaaggcatcatcagct

SEQ ID NO: 630 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methylcytidine-3'- phosphorothioate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
ccgatgtggcctactacctgt

SEQ ID NO: 631 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methylcytidine-3'- phosphorothioate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
ccgcaacaagccaggcgtctt

SEQ ID NO: 632 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methylcytidine-3'- phosphorothioate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
ccgcaagagtctgtcttcgat

SEQ ID NO: 633 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methylcytidine-3'- phosphorothioate
  modified_base 9: mod_base = OTHER; note = 2'-fluorocytidine-3'-phosphate
  modified_base 10: mod_base = OTHER; note = 2'-fluoroguanosine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
ccggaacccggacaacgacat

SEQ ID NO: 634 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methylcytidine-3'- phosphorothioate
  modified_base 9: mod_base = OTHER; note = 2'-fluorocytidine-3'-phosphate
  modified_base 10: mod_base = OTHER; note = 2'-fluoroguanosine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
ccggaacccggacaacgacat

SEQ ID NO: 635 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methylcytidine-3'- phosphorothioate
  modified_base 9: mod_base = OTHER; note = 2'-fluorocadenosine-3'-phosphate
  modified_base 10: mod_base = OTHER; note = 2'-fluoroguanosine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
cctgcaggaggcgcaggtact

SEQ ID NO: 636 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methylcytidine-3'- phosphorothioate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 21: mod_base = OTHER; note = L96
  source 1..21: mol_type = other RNA
cctgtcgccttacgttcagct

SEQ ID NO: 637 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methylcytidine-3'- phosphorothioate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 21: mod_base = OTHER; note = L96
  source 1..21: mol_type = other RNA
cctgtcgccttacgttcagct

SEQ ID NO: 638 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methylcytidine-3'- phosphorothioate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
ccttacgttcagccggtgtgt

SEQ ID NO: 639 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methylguanosine-3'- phosphorothioate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
cgcaacaagccaggcgtctat

SEQ ID NO: 640 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methylguanosine-3'- phosphorothioate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
cgcaggaactcaataaagtgt

SEQ ID NO: 641 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methylguanosine-3'- phosphorothioate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 21: mod_base = OTHER; note = L96
  source 1..21: mol_type = other RNA
cgccttacgttcagccggtgt

SEQ ID NO: 642 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methylguanosine-3'- phosphorothioate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
cgctcctgtcgccttacgttt

SEQ ID NO: 643 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methylguanosine-3'- phosphorothioate
  modified_base 9: mod_base = OTHER; note = 2'-fluoroguanosine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
cggaacccggacaacgacatt

SEQ ID NO: 644 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methylguanosine-3'- phosphorothioate
  modified_base 9: mod_base = OTHER; note = 2'-cytidine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
cggctccgcaagagtctgtct

SEQ ID NO: 645 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methylguanosine-3'- phosphorothioate
  modified_base 9: mod_base = OTHER; note = 2'-cytidine-3'-phosphate
  modified_base 10: mod_base = OTHER; note = 2'-fluorocytidine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
cgtctacaccgatgtggcctt

SEQ ID NO: 646 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methylguanosine-3'- phosphorothioate
  modified_base 9: mod_base = OTHER; note = 2'-fluoroguanosine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 21: mod_base = OTHER; note = L96
  source 1..21: mol_type = other RNA
cgtgccagggtgattccggat

SEQ ID NO: 647 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methyluridine-3'- phosphorothioate
  modified_base 9: mod_base = OTHER; note = 2'-fluorocytidine-3'-phosphate
  modified_base 10: mod_base = OTHER; note = 2'-fluorocytidine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
ctacatcgccgcgctgtactt

SEQ ID NO: 648 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methyluridine-3'- phosphorothioate
  modified_base 9: mod_base = OTHER; note = 2'-fluorocytidine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 21: mod_base = OTHER; note = L96
  source 1..21: mol_type = other RNA
ctacctggcctggatccgggt

SEQ ID NO: 649 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methyluridine-3'- phosphorothioate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 21: mod_base = OTHER; note = L96
  source 1..21: mol_type = other RNA
ctcaataaagtgctttgaaat

SEQ ID NO: 650 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methyluridine-3'- phosphorothioate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 21: mod_base = OTHER; note = L96
  source 1..21: mol_type = other RNA
ctcaataaagtgctttgaaat

SEQ ID NO: 651 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methyluridine-3'- phosphorothioate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
ctcagggactcatctttccct

SEQ ID NO: 652 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methyluridine-3'- phosphorothioate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
ctcctgtcgccttacgttcat

SEQ ID NO: 653 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methyluridine-3'- phosphorothioate
  modified_base 9: mod_base = OTHER; note = 2'-fluorocytidine-3'-phosphate
  modified_base 10: mod_base = OTHER; note = 2'-fluoroguanosine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
ctctgttgcgccttcaggagt

SEQ ID NO: 654 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methyluridine-3'- phosphorothioate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
ctgaagagcacacagtcgttt

SEQ ID NO: 655 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methyluridine-3'- phosphorothioate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
ctgattgctcagggactcatt

SEQ ID NO: 656 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methyluridine-3'- phosphorothioate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 21: mod_base = OTHER; note = L96
  source 1..21: mol_type = other RNA
ctgcaaggcatcatcagctgt

SEQ ID NO: 657 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methyluridine-3'- phosphorothioate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
ctgccggaacccggacaacgt

SEQ ID NO: 658 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methyluridine-3'- phosphorothioate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
ctgtaccacaaatgtacccat

SEQ ID NO: 659 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methyluridine-3'- phosphorothioate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
ctgtcgccttacgttcagcct

SEQ ID NO: 660 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methyluridine-3'- phosphorothioate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
ctgtctctgtccacaacacct

SEQ ID NO: 661 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methyluridine-3'- phosphorothioate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
ctgtggtgaccgcaacaagct

SEQ ID NO: 662 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methyluridine-3'- phosphorothioate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
cttacgttcagccggtgtgct

SEQ ID NO: 663 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methyluridine-3'- phosphorothioate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
cttcgatgacccgcgtcgttt

SEQ ID NO: 664 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methyluridine-3'- phosphorothioate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
cttggagtcaacactttcgat

SEQ ID NO: 665 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methyluridine-3'- phosphorothioate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
ctttgagcctcagcttctcct

SEQ ID NO: 666 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methyladenosine-3'- phosphorothioate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
gaaagtgaaagaccactgcat

SEQ ID NO: 667 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methyladenosine-3'- phosphorothioate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
gaacccggacaacgacatcct

SEQ ID NO: 668 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methyladenosine-3'- phosphorothioate
  modified_base 9: mod_base = OTHER; note = 2'-fluorouridine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
gaactcaataaagtgctttgt

SEQ ID NO: 669 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methyladenosine-3'- phosphorothioate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
gaagagcacacagtcgttctt

SEQ ID NO: 670 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methyladenosine-3'- phosphorothioate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
gaccgcaacaagccaggcgtt

SEQ ID NO: 671 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methyladenosine-3'- phosphorothioate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 21: mod_base = OTHER; note = L96
  source 1..21: mol_type = other RNA
gagcacacagtcgttctcact

SEQ ID NO: 672 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methyladenosine-3'- phosphorothioate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
gagcataagtacaaagctgat

SEQ ID NO: 673 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methyladenosine-3'- phosphorothioate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
gagcctcagcttctccggttt

SEQ ID NO: 674 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methyladenosine-3'- phosphorothioate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 21: mod_base = OTHER; note = L96
  source 1..21: mol_type = other RNA
gagtctgtcttcgatgaccct

SEQ ID NO: 675 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methyladenosine-3'- phosphorothioate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
gatgccagtgcaagggtcctt

SEQ ID NO: 676 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methyladenosine-3'- phosphorothioate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
gatggcgcaggaactcaatat

SEQ ID NO: 677 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methyladenosine-3'- phosphorothioate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
gattgctcagggactcatctt

SEQ ID NO: 678 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methylcytidine-3'- phosphorothioate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
gcaagagtctgtcttcgatgt

SEQ ID NO: 679 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methylcytidine-3'- phosphorothioate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
gcacacagtcgttctcactgt

SEQ ID NO: 680 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methylcytidine-3'- phosphorothioate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
gcacgacctggctctgttgct

SEQ ID NO: 681 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methylcytidine-3'- phosphorothioate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
gcacgacctggctctgttgct

SEQ ID NO: 682 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methylcytidine-3'- phosphorothioate
  modified_base 9: mod_base = OTHER; note = 2'-fluoroguanosine-3'-phosphate
  modified_base 10: mod_base = OTHER; note = 2'-fluoroguanosine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
gcagctgtggccagatgccat

SEQ ID NO: 683 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methylcytidine-3'- phosphorothioate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
gcaggaactcaataaagtgct

SEQ ID NO: 684 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methylcytidine-3'- phosphorothioate
  modified_base 9: mod_base = OTHER; note = 2'-fluorocytidine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
gccagatgccagtgcaagggt

SEQ ID NO: 685 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methylcytidine-3'- phosphorothioate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 21: mod_base = OTHER; note = L96
  source 1..21: mol_type = other RNA
gccaggcgtctacaccgatgt

SEQ ID NO: 686 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methylcytidine-3'- phosphorothioate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
gcccaagaaagtgaaagacct

SEQ ID NO: 687 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methylcytidine-3'- phosphorothioate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
gccttacgttcagccggtgtt

SEQ ID NO: 688 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methylcytidine-3'- phosphorothioate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 21: mod_base = OTHER; note = L96
  source 1..21: mol_type = other RNA
gcgcaggaactcaataaagtt

SEQ ID NO: 689 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methylcytidine-3'- phosphorothioate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
gcgccttcaggaggatgcggt

SEQ ID NO: 690 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methylcytidine-3'- phosphorothioate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
gcggctccgcaagagtctgtt

SEQ ID NO: 691 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methylcytidine-3'- phosphorothioate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 21: mod_base = OTHER; note = L96
  source 1..21: mol_type = other RNA
gctcagggactcatctttcct

SEQ ID NO: 692 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methylcytidine-3'- phosphorothioate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
gctccgcaagagtctgtcttt

SEQ ID NO: 693 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methylcytidine-3'- phosphorothioate
  modified_base 9: mod_base = OTHER; note = 2'-fluorocytidine-3'-phosphate
  modified_base 10: mod_base = OTHER; note = 2'-fluoroguanosine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
gctcctgtcgccttacgttct

SEQ ID NO: 694 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methylcytidine-3'- phosphorothioate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
gctctgcgcagggttcctcgt

SEQ ID NO: 695 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methylcytidine-3'- phosphorothioate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
gctctgcgcagggttcctcgt

SEQ ID NO: 696 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methylcytidine-3'- phosphorothioate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
gctctgttgcgccttcaggat

SEQ ID NO: 697 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methylcytidine-3'- phosphorothioate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
gctctgttgcgccttcaggat

SEQ ID NO: 698 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methylcytidine-3'- phosphorothioate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
gctgaagagcacacagtcgtt

SEQ ID NO: 699 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methylcytidine-3'- phosphorothioate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 21: mod_base = OTHER; note = L96
  source 1..21: mol_type = other RNA
gctgctatgatggccgcgggt

SEQ ID NO: 700 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methylcytidine-3'- phosphorothioate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
gctggtgtgtgaggaccaagt

SEQ ID NO: 701 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methylcytidine-3'- phosphorothioate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
gctgtggtgaccgcaacaagt

SEQ ID NO: 702 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methylcytidine-3'- phosphorothioate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
gctgtggtgaccgcaacaagt

SEQ ID NO: 703 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methylcytidine-3'- phosphorothioate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
gcttcatgtcccactcatgct

SEQ ID NO: 704 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methylcytidine-3'- phosphorothioate
  modified_base 9: mod_base = OTHER; note = 2'-fluorocytidine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 21: mod_base = OTHER; note = L96
  source 1..21: mol_type = other RNA
gctttgagcctcagcttctct

SEQ ID NO: 705 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methylguanosine-3'- phosphorothioate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
ggaactcaataaagtgctttt

SEQ ID NO: 706 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methylguanosine-3'- phosphorothioate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 21: mod_base = OTHER; note = L96
  source 1..21: mol_type = other RNA
ggagcataagtacaaagctgt

SEQ ID NO: 707 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methylguanosine-3'- phosphorothioate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
ggagcccaagaaagtgaaagt

SEQ ID NO: 708 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methylguanosine-3'- phosphorothioate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
ggagtcaacactttcgattct

SEQ ID NO: 709 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methylguanosine-3'- phosphorothioate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
ggcgtctacaccgatgtggct

SEQ ID NO: 710 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methylguanosine-3'- phosphorothioate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
ggcgtctacaccgatgtggct

SEQ ID NO: 711 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methylguanosine-3'- phosphorothioate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
ggctccgcaagagtctgtctt

SEQ ID NO: 712 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methylguanosine-3'- phosphorothioate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
ggctctgttgcgccttcaggt

SEQ ID NO: 713 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methylguanosine-3'- phosphorothioate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
gggtcctgatgcccactgcct

SEQ ID NO: 714 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methyluridine-3'- phosphorothioate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 21: mod_base = OTHER; note = L96
  source 1..21: mol_type = other RNA
gtcaacactttcgattccact

SEQ ID NO: 715 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methyluridine-3'- phosphorothioate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 21: mod_base = OTHER; note = L96
  source 1..21: mol_type = other RNA
gtcaacactttcgattccact

SEQ ID NO: 716 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methyluridine-3'- phosphorothioate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
gtcgccttacgttcagccggt

SEQ ID NO: 717 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methyluridine-3'- phosphorothioate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
gtcgccttacgttcagccggt

SEQ ID NO: 718 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methyluridine-3'- phosphorothioate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
gtcgttctcactgtcaccggt

SEQ ID NO: 719 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methyluridine-3'- phosphorothioate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
gtctgtcttcgatgacccgct

SEQ ID NO: 720 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methyluridine-3'- phosphorothioate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
gtcttcgatgacccgcgtcgt

SEQ ID NO: 721 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methyluridine-3'- phosphorothioate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
gtgcaagggtcctgatgccct

SEQ ID NO: 722 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methyluridine-3'- phosphorothioate
  modified_base 9: mod_base = OTHER; note = 2'-fluorocytidine-3'-phosphate
  modified_base 10: mod_base = OTHER; note = 2'-fluoroguanosine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
gtggtgaccgcaacaagccat

SEQ ID NO: 723 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methyluridine-3'- phosphorothioate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
gttgcgccttcaggaggatgt

SEQ ID NO: 724 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methyluridine-3'- phosphorothioate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
gttgcgccttcaggaggatgt

SEQ ID NO: 725 - RNA, 21 nt, synthetic construct
  misc_feature 1..21: note = Synthetic
  modified_base 1: mod_base = OTHER; note = 2'-O-methyluridine-3'- phosphorothioate
  modified_base 2: mod_base = OTHER; note = 2'-O-methyladenosine-3'- phosphorothioate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
taagtacaaagctgaagagct

SEQ ID NO: 726 - RNA, 21 nt, synthetic construct
  misc_feature 1..21: note = Synthetic
  modified_base 1: mod_base = OTHER; note = 2'-O-methyluridine-3'- phosphorothioate
  modified_base 2: mod_base = OTHER; note = 2'-O-methyladenosine-3'- phosphorothioate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
taagtacaaagctgaagagct

SEQ ID NO: 727 - RNA, 21 nt, synthetic construct
  misc_feature 1..21: note = Synthetic
  modified_base 1: mod_base = OTHER; note = 2'-O-methyluridine-3'- phosphorothioate
  modified_base 2: mod_base = OTHER; note = 2'-O-methyladenosine-3'- phosphorothioate
  modified_base 9: mod_base = OTHER; note = 2'-fluorocytidine-3'-phosphate
  modified_base 10: mod_base = OTHER; note = 2'-fluoroguanosine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
tacatcgccgcgctgtactgt

SEQ ID NO: 728 - RNA, 21 nt, synthetic construct
  misc_feature 1..21: note = Synthetic
  modified_base 1: mod_base = OTHER; note = 2'-O-methyluridine-3'- phosphorothioate
  modified_base 2: mod_base = OTHER; note = 2'-O-methyladenosine-3'- phosphorothioate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
tacctggcctggatccgggat

SEQ ID NO: 729 - RNA, 21 nt, synthetic construct
  misc_feature 1..21: note = Synthetic
  modified_base 1: mod_base = OTHER; note = 2'-O-methyluridine-3'- phosphorothioate
  modified_base 2: mod_base = OTHER; note = 2'-O-methyladenosine-3'- phosphorothioate
  modified_base 9: mod_base = OTHER; note = 2'-fluoroguanosine-3'-phosphate
  modified_base 10: mod_base = OTHER; note = 2'-fluoroguanosine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
tactacctggcctggatccgt

SEQ ID NO: 730 - RNA, 21 nt, synthetic construct
  misc_feature 1..21: note = Synthetic
  modified_base 1: mod_base = OTHER; note = 2'-O-methyluridine-3'- phosphorothioate
  modified_base 2: mod_base = OTHER; note = 2'-O-methylcytidine-3'- phosphorothioate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
tcaacactttcgattccacct

SEQ ID NO: 731 - RNA, 21 nt, synthetic construct
  misc_feature 1..21: note = Synthetic
  modified_base 1: mod_base = OTHER; note = 2'-O-methyluridine-3'- phosphorothioate
  modified_base 2: mod_base = OTHER; note = 2'-O-methylcytidine-3'- phosphorothioate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
tcaccctgcaaggcatcatct

SEQ ID NO: 732 - RNA, 21 nt, synthetic construct
  misc_feature 1..21: note = Synthetic
  modified_base 1: mod_base = OTHER; note = 2'-O-methyluridine-3'- phosphorothioate
  modified_base 2: mod_base = OTHER; note = 2'-O-methylcytidine-3'- phosphorothioate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 21: mod_base = OTHER; note = L96
  source 1..21: mol_type = other RNA
tcagccggtgtgcctgccaat

SEQ ID NO: 733 - RNA, 21 nt, synthetic construct
  misc_feature 1..21: note = Synthetic
  modified_base 1: mod_base = OTHER; note = 2'-O-methyluridine-3'- phosphorothioate
  modified_base 2: mod_base = OTHER; note = 2'-O-methylcytidine-3'- phosphorothioate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
tcaggaggatgcggacggcat

SEQ ID NO: 734 - RNA, 21 nt, synthetic construct
  misc_feature 1..21: note = Synthetic
  modified_base 1: mod_base = OTHER; note = 2'-O-methyluridine-3'- phosphorothioate
  modified_base 2: mod_base = OTHER; note = 2'-O-methylcytidine-3'- phosphorothioate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
tcagggactcatctttccctt

SEQ ID NO: 735 - RNA, 21 nt, synthetic construct
  misc_feature 1..21: note = Synthetic
  modified_base 1: mod_base = OTHER; note = 2'-O-methyluridine-3'- phosphorothioate
  modified_base 2: mod_base = OTHER; note = 2'-O-methylcytidine-3'- phosphorothioate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 21: mod_base = OTHER; note = L96
  source 1..21: mol_type = other RNA
tccgcaagagtctgtcttcgt

SEQ ID NO: 736 - RNA, 21 nt, synthetic construct
  misc_feature 1..21: note = Synthetic
  modified_base 1: mod_base = OTHER; note = 2'-O-methyluridine-3'- phosphorothioate
  modified_base 2: mod_base = OTHER; note = 2'-O-methylcytidine-3'- phosphorothioate
  modified_base 9: mod_base = OTHER; note = 2'-fluorocytidine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 21: mod_base = OTHER; note = L96
  source 1..21: mol_type = other RNA
tcctgtcgccttacgttcagt

SEQ ID NO: 737 - RNA, 21 nt, synthetic construct
  misc_feature 1..21: note = Synthetic
  modified_base 1: mod_base = OTHER; note = 2'-O-methyluridine-3'- phosphorothioate
  modified_base 2: mod_base = OTHER; note = 2'-O-methylcytidine-3'- phosphorothioate
  modified_base 9: mod_base = OTHER; note = 2'-fluorocytidine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 21: mod_base = OTHER; note = L96
  source 1..21: mol_type = other RNA
tcgccttacgttcagccggtt

SEQ ID NO: 738 - RNA, 21 nt, synthetic construct
  misc_feature 1..21: note = Synthetic
  modified_base 1: mod_base = OTHER; note = 2'-O-methyluridine-3'- phosphorothioate
  modified_base 2: mod_base = OTHER; note = 2'-O-methylcytidine-3'- phosphorothioate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
tctctgtccacaacacctcat

SEQ ID NO: 739 - RNA, 21 nt, synthetic construct
  misc_feature 1..21: note = Synthetic
  modified_base 1: mod_base = OTHER; note = 2'-O-methyluridine-3'- phosphorothioate
  modified_base 2: mod_base = OTHER; note = 2'-O-methylcytidine-3'- phosphorothioate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
tctgttgcgccttcaggaggt

SEQ ID NO: 740 - RNA, 21 nt, synthetic construct
  misc_feature 1..21: note = Synthetic
  modified_base 1: mod_base = OTHER; note = 2'-O-methyluridine-3'- phosphorothioate
  modified_base 2: mod_base = OTHER; note = 2'-O-methylguanosine-3'- phosphorothioate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
tgaagagcacacagtcgttct

SEQ ID NO: 741 - RNA, 21 nt, synthetic construct
  misc_feature 1..21: note = Synthetic
  modified_base 1: mod_base = OTHER; note = 2'-O-methyluridine-3'- phosphorothioate
  modified_base 2: mod_base = OTHER; note = 2'-O-methylguanosine-3'- phosphorothioate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
tgagcctcagcttctccggtt

SEQ ID NO: 742 - RNA, 21 nt, synthetic construct
  misc_feature 1..21: note = Synthetic
  modified_base 1: mod_base = OTHER; note = 2'-O-methyluridine-3'- phosphorothioate
  modified_base 2: mod_base = OTHER; note = 2'-O-methylguanosine-3'- phosphorothioate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
tgagctgggagtactgcgact

SEQ ID NO: 743 - RNA, 21 nt, synthetic construct
  misc_feature 1..21: note = Synthetic
  modified_base 1: mod_base = OTHER; note = 2'-O-methyluridine-3'- phosphorothioate
  modified_base 2: mod_base = OTHER; note = 2'-O-methylguanosine-3'- phosphorothioate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
tgatggccgcgggctcagctt

SEQ ID NO: 744 - RNA, 21 nt, synthetic construct
  misc_feature 1..21: note = Synthetic
  modified_base 1: mod_base = OTHER; note = 2'-O-methyluridine-3'- phosphorothioate
  modified_base 2: mod_base = OTHER; note = 2'-O-methylguanosine-3'- phosphorothioate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
tgcaaggcatcatcagctggt

SEQ ID NO: 745 - RNA, 21 nt, synthetic construct
  misc_feature 1..21: note = Synthetic
  modified_base 1: mod_base = OTHER; note = 2'-O-methyluridine-3'- phosphorothioate
  modified_base 2: mod_base = OTHER; note = 2'-O-methylguanosine-3'- phosphorothioate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
tgcaaggcatcatcagctggt

SEQ ID NO: 746 - RNA, 21 nt, synthetic construct
  misc_feature 1..21: note = Synthetic
  modified_base 1: mod_base = OTHER; note = 2'-O-methyluridine-3'- phosphorothioate
  modified_base 2: mod_base = OTHER; note = 2'-O-methylguanosine-3'- phosphorothioate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
tgcaagggtcctgatgcccat

SEQ ID NO: 747 - RNA, 21 nt, synthetic construct
  misc_feature 1..21: note = Synthetic
  modified_base 1: mod_base = OTHER; note = 2'-O-methyluridine-3'- phosphorothioate
  modified_base 2: mod_base = OTHER; note = 2'-O-methylguanosine-3'- phosphorothioate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
tgccagtgcaagggtcctgat

SEQ ID NO: 748 - RNA, 21 nt, synthetic construct
  misc_feature 1..21: note = Synthetic
  modified_base 1: mod_base = OTHER; note = 2'-O-methyluridine-3'- phosphorothioate
  modified_base 2: mod_base = OTHER; note = 2'-O-methylguanosine-3'- phosphorothioate
  modified_base 9: mod_base = OTHER; note = 2'-fluoroguanosine-3'-phosphate
  modified_base 10: mod_base = OTHER; note = 2'-fluoroguanosine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
tgccatgagggctctgctgct

SEQ ID NO: 749 - RNA, 21 nt, synthetic construct
  misc_feature 1..21: note = Synthetic
  modified_base 1: mod_base = OTHER; note = 2'-O-methyluridine-3'- phosphorothioate
  modified_base 2: mod_base = OTHER; note = 2'-O-methylguanosine-3'- phosphorothioate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
tgcgccttcaggaggatgcgt

SEQ ID NO: 750 - RNA, 21 nt, synthetic construct
  misc_feature 1..21: note = Synthetic
  modified_base 1: mod_base = OTHER; note = 2'-O-methyluridine-3'- phosphorothioate
  modified_base 2: mod_base = OTHER; note = 2'-O-methylguanosine-3'- phosphorothioate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
tgctcagggactcatctttct

SEQ ID NO: 751 - RNA, 21 nt, synthetic construct
  misc_feature 1..21: note = Synthetic
  modified_base 1: mod_base = OTHER; note = 2'-O-methyluridine-3'- phosphorothioate
  modified_base 2: mod_base = OTHER; note = 2'-O-methylguanosine-3'- phosphorothioate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
tgctcagggactcatctttct

SEQ ID NO: 752 - RNA, 21 nt, synthetic construct
  misc_feature 1..21: note = Synthetic
  modified_base 1: mod_base = OTHER; note = 2'-O-methyluridine-3'- phosphorothioate
  modified_base 2: mod_base = OTHER; note = 2'-O-methylguanosine-3'- phosphorothioate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
tggagtcaacactttcgattt

SEQ ID NO: 753 - RNA, 21 nt, synthetic construct
  misc_feature 1..21: note = Synthetic
  modified_base 1: mod_base = OTHER; note = 2'-O-methyluridine-3'- phosphorothioate
  modified_base 2: mod_base = OTHER; note = 2'-O-methylguanosine-3'- phosphorothioate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
tggccagatgccagtgcaagt

SEQ ID NO: 754 - RNA, 21 nt, synthetic construct
  misc_feature 1..21: note = Synthetic
  modified_base 1: mod_base = OTHER; note = 2'-O-methyluridine-3'- phosphorothioate
  modified_base 2: mod_base = OTHER; note = 2'-O-methylguanosine-3'- phosphorothioate
  modified_base 9: mod_base = OTHER; note = 2'-fluorouridine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
tggcctactacctggcctggt

SEQ ID NO: 755 - RNA, 21 nt, synthetic construct
  misc_feature 1..21: note = Synthetic
  modified_base 1: mod_base = OTHER; note = 2'-O-methyluridine-3'- phosphorothioate
  modified_base 2: mod_base = OTHER; note = 2'-O-methylguanosine-3'- phosphorothioate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
tggctctgttgcgccttcagt

SEQ ID NO: 756 - RNA, 21 nt, synthetic construct
  misc_feature 1..21: note = Synthetic
  modified_base 1: mod_base = OTHER; note = 2'-O-methyluridine-3'- phosphorothioate
  modified_base 2: mod_base = OTHER; note = 2'-O-methylguanosine-3'- phosphorothioate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
tggtgaccgcaacaagccagt

SEQ ID NO: 757 - RNA, 21 nt, synthetic construct
  misc_feature 1..21: note = Synthetic
  modified_base 1: mod_base = OTHER; note = 2'-O-methyluridine-3'- phosphorothioate
  modified_base 2: mod_base = OTHER; note = 2'-O-methylguanosine-3'- phosphorothioate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
tgtaccacaaatgtacccact

SEQ ID NO: 758 - RNA, 21 nt, synthetic construct
  misc_feature 1..21: note = Synthetic
  modified_base 1: mod_base = OTHER; note = 2'-O-methyluridine-3'- phosphorothioate
  modified_base 2: mod_base = OTHER; note = 2'-O-methylguanosine-3'- phosphorothioate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
tgtctctgtccacaacacctt

SEQ ID NO: 759 - RNA, 21 nt, synthetic construct
  misc_feature 1..21: note = Synthetic
  modified_base 1: mod_base = OTHER; note = 2'-O-methyluridine-3'- phosphorothioate
  modified_base 2: mod_base = OTHER; note = 2'-O-methylguanosine-3'- phosphorothioate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 21: mod_base = OTHER; note = L96
  source 1..21: mol_type = other RNA
tgtggccagatgccagtgcat

SEQ ID NO: 760 - RNA, 21 nt, synthetic construct
  misc_feature 1..21: note = Synthetic
  modified_base 1: mod_base = OTHER; note = 2'-O-methyluridine-3'- phosphorothioate
  modified_base 2: mod_base = OTHER; note = 2'-O-methyluridine-3'- phosphorothioate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
ttacgttcagccggtgtgcct

SEQ ID NO: 761 - RNA, 21 nt, synthetic construct
  misc_feature 1..21: note = Synthetic
  modified_base 1: mod_base = OTHER; note = 2'-O-methyluridine-3'- phosphorothioate
  modified_base 2: mod_base = OTHER; note = 2'-O-methyluridine-3'- phosphorothioate
  modified_base 9: mod_base = OTHER; note = 2'-fluorocytidine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
ttcatgtcccactcatgccct

SEQ ID NO: 762 - RNA, 21 nt, synthetic construct
  misc_feature 1..21: note = Synthetic
  modified_base 1: mod_base = OTHER; note = 2'-O-methyluridine-3'- phosphorothioate
  modified_base 2: mod_base = OTHER; note = 2'-O-methyluridine-3'- phosphorothioate
  modified_base 9: mod_base = OTHER; note = 2'-fluorocytidine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
ttcgatgacccgcgtcgttgt

SEQ ID NO: 763 - RNA, 21 nt, synthetic construct
  misc_feature 1..21: note = Synthetic
  modified_base 1: mod_base = OTHER; note = 2'-O-methyluridine-3'- phosphorothioate
  modified_base 2: mod_base = OTHER; note = 2'-O-methyluridine-3'- phosphorothioate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
ttgagcctcagcttctccggt

SEQ ID NO: 764 - RNA, 21 nt, synthetic construct
  misc_feature 1..21: note = Synthetic
  modified_base 1: mod_base = OTHER; note = 2'-O-methyluridine-3'- phosphorothioate
  modified_base 2: mod_base = OTHER; note = 2'-O-methyluridine-3'- phosphorothioate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
ttggagcccaagaaagtgaat

SEQ ID NO: 765 - RNA, 21 nt, synthetic construct
  misc_feature 1..21: note = Synthetic
  modified_base 1: mod_base = OTHER; note = 2'-O-methyluridine-3'- phosphorothioate
  modified_base 2: mod_base = OTHER; note = 2'-O-methyluridine-3'- phosphorothioate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
ttggagtcaacactttcgatt

SEQ ID NO: 766 - RNA, 21 nt, synthetic construct
  misc_feature 1..21: note = Synthetic
  modified_base 1: mod_base = OTHER; note = 2'-O-methyluridine-3'- phosphorothioate
  modified_base 2: mod_base = OTHER; note = 2'-O-methyluridine-3'- phosphorothioate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
tttgagcctcagcttctccgt

SEQ ID NO: 767 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
aagagcacacagtcgttctct

SEQ ID NO: 768 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 21: mod_base = OTHER; note = L96
  source 1..21: mol_type = other RNA
aataaagtgctttgaaaatgt

SEQ ID NO: 769 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methylcytidine-3'- phosphorothioate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
acatcgccgcgctgtactggt

SEQ ID NO: 770 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methylcytidine-3'- phosphorothioate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
accagcacgacctggctctgt

SEQ ID NO: 771 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methylcytidine-3'- phosphorothioate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
accctgcaaggcatcatcagt

SEQ ID NO: 772 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methylcytidine-3'- phosphorothioate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
accgcaacaagccaggcgtct

SEQ ID NO: 773 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methylcytidine-3'- phosphorothioate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
actacctggcctggatccggt

SEQ ID NO: 774 - RNA, 21 nt, synthetic construct
  misc_feature 1..21: note = SyntheticAlvin, Carmen, Alvaro - 3 grilled pork vermicelli bowlJasmine/Leila - 1 grilled pork vermicelli bowl - NO NUTS, EGG ROLLS ON SIDE1 order fresh summer rollsJasmine - 1 regular pho with chickenChrissy - 1 large pho with beef (P3)
  source 1..21: mol_type = other RNA
attgctcagggactcatcttt

SEQ ID NO: 775 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 21: mod_base = OTHER; note = L96
  source 1..21: mol_type = other RNA
cagggactcatctttccctct

SEQ ID NO: 776 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methylcytidine-3'- phosphorothioate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
ccacaaatgtacccacaaggt

SEQ ID NO: 777 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methylcytidine-3'- phosphorothioate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
ccgcaagagtctgtcttcgat

SEQ ID NO: 778 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methylcytidine-3'- phosphorothioate
  modified_base 9: mod_base = OTHER; note = 2'-fluorocytidine-3'-phosphate
  modified_base 10: mod_base = OTHER; note = 2'-fluoroguanosine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
ccggaacccggacaacgacat

SEQ ID NO: 779 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methylcytidine-3'- phosphorothioate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 21: mod_base = OTHER; note = L96
  source 1..21: mol_type = other RNA
cctgtcgccttacgttcagct

SEQ ID NO: 780 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methylguanosine-3'- phosphorothioate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 21: mod_base = OTHER; note = L96
  source 1..21: mol_type = other RNA
cgccttacgttcagccggtgt

SEQ ID NO: 781 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methylguanosine-3'- phosphorothioate
  modified_base 9: mod_base = OTHER; note = 2'-fluoroguanosine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 21: mod_base = OTHER; note = L96
  source 1..21: mol_type = other RNA
cgtgccagggtgattccggat

SEQ ID NO: 782 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methyluridine-3'- phosphorothioate
  modified_base 9: mod_base = OTHER; note = 2'-fluorocytidine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 21: mod_base = OTHER; note = L96
  source 1..21: mol_type = other RNA
ctacctggcctggatccgggt

SEQ ID NO: 783 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methyluridine-3'- phosphorothioate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
ctcagggactcatctttccct

SEQ ID NO: 784 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methyluridine-3'- phosphorothioate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
cttcgatgacccgcgtcgttt

SEQ ID NO: 785 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methyladenosine-3'- phosphorothioate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
gaagagcacacagtcgttctt

SEQ ID NO: 786 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methyladenosine-3'- phosphorothioate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
gagcctcagcttctccggttt

SEQ ID NO: 787 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methylcytidine-3'- phosphorothioate
  modified_base 9: mod_base = OTHER; note = 2'-fluorocytidine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
gccagatgccagtgcaagggt

SEQ ID NO: 788 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methylcytidine-3'- phosphorothioate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
gccttacgttcagccggtgtt

SEQ ID NO: 789 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methylcytidine-3'- phosphorothioate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 21: mod_base = OTHER; note = L96
  source 1..21: mol_type = other RNA
gcgcaggaactcaataaagtt

SEQ ID NO: 790 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methylcytidine-3'- phosphorothioate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
gcgccttcaggaggatgcggt

SEQ ID NO: 791 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methylcytidine-3'- phosphorothioate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 21: mod_base = OTHER; note = L96
  source 1..21: mol_type = other RNA
gctcagggactcatctttcct

SEQ ID NO: 792 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methylcytidine-3'- phosphorothioate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
gctctgcgcagggttcctcgt

SEQ ID NO: 793 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methylcytidine-3'- phosphorothioate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
gctctgttgcgccttcaggat

SEQ ID NO: 794 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methylcytidine-3'- phosphorothioate
  modified_base 9: mod_base = OTHER; note = 2'-fluorocytidine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 21: mod_base = OTHER; note = L96
  source 1..21: mol_type = other RNA
gctttgagcctcagcttctct

SEQ ID NO: 795 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methylguanosine-3'- phosphorothioate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
ggagtcaacactttcgattct

SEQ ID NO: 796 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methylguanosine-3'- phosphorothioate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
ggctctgttgcgccttcaggt

SEQ ID NO: 797 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methyluridine-3'- phosphorothioate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
gtcgccttacgttcagccggt

SEQ ID NO: 798 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methyluridine-3'- phosphorothioate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
gtcttcgatgacccgcgtcgt

SEQ ID NO: 799 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methyluridine-3'- phosphorothioate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
gttgcgccttcaggaggatgt

SEQ ID NO: 800 - RNA, 21 nt, synthetic construct
  misc_feature 1..21: note = Synthetic
  modified_base 1: mod_base = OTHER; note = 2'-O-methyluridine-3'- phosphorothioate
  modified_base 2: mod_base = OTHER; note = 2'-O-methylcytidine-3'- phosphorothioate
  modified_base 9: mod_base = OTHER; note = 2'-fluorocytidine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 21: mod_base = OTHER; note = L96
  source 1..21: mol_type = other RNA
tcgccttacgttcagccggtt

SEQ ID NO: 801 - RNA, 21 nt, synthetic construct
  misc_feature 1..21: note = Synthetic
  modified_base 1: mod_base = OTHER; note = 2'-O-methyluridine-3'- phosphorothioate
  modified_base 2: mod_base = OTHER; note = 2'-O-methylguanosine-3'- phosphorothioate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
tgagcctcagcttctccggtt

SEQ ID NO: 802 - RNA, 21 nt, synthetic construct
  misc_feature 1..21: note = Synthetic
  modified_base 1: mod_base = OTHER; note = 2'-O-methyluridine-3'- phosphorothioate
  modified_base 2: mod_base = OTHER; note = 2'-O-methylguanosine-3'- phosphorothioate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
tgcgccttcaggaggatgcgt

SEQ ID NO: 803 - RNA, 21 nt, synthetic construct
  misc_feature 1..21: note = Synthetic
  modified_base 1: mod_base = OTHER; note = 2'-O-methyluridine-3'- phosphorothioate
  modified_base 2: mod_base = OTHER; note = 2'-O-methylguanosine-3'- phosphorothioate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
tgctcagggactcatctttct

SEQ ID NO: 804 - RNA, 21 nt, synthetic construct
  misc_feature 1..21: note = Synthetic
  modified_base 1: mod_base = OTHER; note = 2'-O-methyluridine-3'- phosphorothioate
  modified_base 2: mod_base = OTHER; note = 2'-O-methylguanosine-3'- phosphorothioate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
tggagtcaacactttcgattt

SEQ ID NO: 805 - RNA, 21 nt, synthetic construct
  misc_feature 1..21: note = Synthetic
  modified_base 1: mod_base = OTHER; note = 2'-O-methyluridine-3'- phosphorothioate
  modified_base 2: mod_base = OTHER; note = 2'-O-methylguanosine-3'- phosphorothioate
  modified_base 9: mod_base = OTHER; note = 2'-fluorouridine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
tggcctactacctggcctggt

SEQ ID NO: 806 - RNA, 21 nt, synthetic construct
  misc_feature 1..21: note = Synthetic
  modified_base 1: mod_base = OTHER; note = 2'-O-methyluridine-3'- phosphorothioate
  modified_base 2: mod_base = OTHER; note = 2'-O-methyluridine-3'- phosphorothioate
  modified_base 9: mod_base = OTHER; note = 2'-fluorocytidine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 21: mod_base = OTHER; note = L96
  source 1..21: mol_type = other RNA
ttcgatgacccgcgtcgttgt

SEQ ID NO: 807 - RNA, 21 nt, synthetic construct
  misc_feature 1..21: note = Synthetic
  modified_base 1: mod_base = OTHER; note = 2'-O-methyluridine-3'- phosphorothioate
  modified_base 2: mod_base = OTHER; note = 2'-O-methyluridine-3'- phosphorothioate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
ttgagcctcagcttctccggt

SEQ ID NO: 808 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methylcytidine-3'- phosphorothioate
  modified_base 7: mod_base = OTHER; note = 2'-fluorouridine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
actcaataaagtgctttgaaa

SEQ ID NO: 809 - RNA, 21 nt, synthetic construct
  misc_feature 1..21: note = Synthetic
  modified_base 1: mod_base = OTHER; note = 2'-O-methyluridine-3'- phosphorothioate
  modified_base 2: mod_base = OTHER; note = 2'-O-methylcytidine-3'- phosphorothioate
  modified_base 7: mod_base = OTHER; note = 2'-fluoroadenosine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 21: mod_base = OTHER; note = L96
  source 1..21: mol_type = other RNA
tcaataaagtgctttgaaaat

SEQ ID NO: 810 - RNA, 21 nt, synthetic construct
  misc_feature 1..21: note = Synthetic
  modified_base 1: mod_base = OTHER; note = 2'-O-methylcytidine-3'- phosphorothioate
  modified_base 2: mod_base = OTHER; note = 2'-O-methyluridine-3'- phosphorothioate
  modified_base 7: mod_base = OTHER; note = 2'-fluoroadenosine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 21: mod_base = OTHER; note = L96
  source 1..21: mol_type = other RNA
ctcaataaagtgctttgaaaa

SEQ ID NO: 811 - RNA, 21 nt, synthetic construct
  misc_feature 1..21: note = Synthetic
  modified_base 1: mod_base = OTHER; note = 2'-O-methylguanosine-3'- phosphorothioate
  modified_base 2: mod_base = OTHER; note = 2'-O-methyladenosine-3'- phosphorothioate
  modified_base 9: mod_base = OTHER; note = 2'-fluorouridine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 21: mod_base = OTHER; note = L96
  source 1..21: mol_type = other RNA
gaactcaataaagtgctttga

SEQ ID NO: 812 - RNA, 21 nt, synthetic construct
  misc_feature 1..21: note = Synthetic
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 7: mod_base = OTHER; note = 2'-fluoroguanosine-3'-phosphate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 21: mod_base = OTHER; note = L96
  source 1..21: mol_type = other RNA
aataaagtgctttgaaaacgt

SEQ ID NO: 813 - RNA, 23 nt, synthetic construct
  modified_base 5: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 5: mod_base = OTHER; note = 2`-deoxythimidine -3`-phosphate
  modified_base 7: mod_base = OTHER; note = Adenosine-glycol nucleic acid (GNA) S-Isomer
  modified_base 14: mod_base = OTHER; note = 2'-fluorouridine-3'-phosphate
  modified_base 16: mod_base = OTHER; note = 2'-fluorocytidine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  source 1..23: mol_type = other RNA
aggctcaaagcacttctctttct

SEQ ID NO: 814 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxycytidine-3`-phosphorothioate
  modified_base 5: mod_base = OTHER; note = 2`-deoxycytidine-3`-phosphate
  modified_base 7: mod_base = OTHER; note = 2`-deoxycytidine-3`-phosphate
  modified_base 12: mod_base = OTHER; note = 2`-deoxyguanosine-3`-phosphate
  modified_base 14: mod_base = OTHER; note = 2'-fluoroguanosine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  source 1..23: mol_type = other RNA
acggcccttgtgggtacatttgt

SEQ ID NO: 815 - RNA, 23 nt, synthetic construct
  modified_base 12: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxycytidine-3`-phosphorothioate
  modified_base 5: mod_base = OTHER; note = 2`-deoxycytidine-3`-phosphate
  modified_base 7: mod_base = OTHER; note = 2`-deoxycytidine-3`-phosphate
  modified_base 12: mod_base = OTHER; note = 2`-deoxyguanosine-3`-phosphate
  modified_base 14: mod_base = OTHER; note = 2'-fluoroguanosine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  source 1..23: mol_type = other RNA
acggatgtcgttgtccgggttcc

SEQ ID NO: 816 - RNA, 23 nt, synthetic construct
  modified_base 2: mod_base = OTHER; note = thymine
  modified_base 12: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxythimidine-3`-phosphorothioate
  modified_base 5: mod_base = OTHER; note = 2`-deoxyadenosine-3`-phosphate
  modified_base 7: mod_base = OTHER; note = 2`-deoxyguanosine-3`-phosphate
  modified_base 12: mod_base = OTHER; note = 2`-deoxythimidine -3`-phosphate
  modified_base 14: mod_base = OTHER; note = 2'-fluoroadenosine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  source 1..23: mol_type = other RNA
atcaaagcactttattgagttcc

SEQ ID NO: 817 - RNA, 23 nt, synthetic construct
  modified_base 12: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxycytidine-3`-phosphorothioate
  modified_base 5: mod_base = OTHER; note = 2`-deoxycytidine-3`-phosphate
  modified_base 7: mod_base = OTHER; note = 2`-deoxyguanosine-3`-phosphate
  modified_base 12: mod_base = OTHER; note = 2`-deoxythimidine -3`-phosphate
  modified_base 14: mod_base = OTHER; note = 2'-fluoroguanosine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  source 1..23: mol_type = other RNA
accacagctgcttgctcagttct

SEQ ID NO: 818 - RNA, 23 nt, synthetic construct
  modified_base 5: mod_base = OTHER; note = thymine
  modified_base 12: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxycytidine-3`-phosphorothioate
  modified_base 5: mod_base = OTHER; note = 2`-deoxythimidine-3`-phosphate
  modified_base 7: mod_base = OTHER; note = 2`-deoxycytidine-3`-phosphate
  modified_base 12: mod_base = OTHER; note = 2`-deoxythimidine -3`-phosphate
  modified_base 14: mod_base = OTHER; note = 2'-fluorouridine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  source 1..23: mol_type = other RNA
actataccatatctcattcttgt

SEQ ID NO: 819 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxyguanosine-3`-phosphorothioate
  modified_base 5: mod_base = OTHER; note = 2`-deoxyadenosine-3`-phosphate
  modified_base 7: mod_base = OTHER; note = 2`-deoxycytidine-3`-phosphate
  modified_base 12: mod_base = OTHER; note = 2`-deoxyguanosine -3`-phosphate
  modified_base 14: mod_base = OTHER; note = 2'-fluoroguanosine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  source 1..23: mol_type = other RNA
agagaacgactgtgtgctcttca

SEQ ID NO: 820 - RNA, 23 nt, synthetic construct
  modified_base 5: mod_base = OTHER; note = thymine
  modified_base 7: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 5: mod_base = OTHER; note = 2`-deoxythimidine -3`-phosphate
  modified_base 7: mod_base = OTHER; note = Thymidine-glycol nucleic acid (GNA) S-Isomer
  modified_base 14: mod_base = OTHER; note = 2'-fluoroadenosine-3'-phosphate
  modified_base 16: mod_base = OTHER; note = 2'-fluorocytidine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  source 1..23: mol_type = other RNA
agcatctggccacagctgcttgc

SEQ ID NO: 821 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxycytidine-3`-phosphorothioate
  modified_base 5: mod_base = OTHER; note = 2`-deoxyguanosine-3`-phosphate
  modified_base 7: mod_base = OTHER; note = 2`-deoxycytidine-3`-phosphate
  modified_base 12: mod_base = OTHER; note = 2`-deoxyadenosine -3`-phosphate
  modified_base 14: mod_base = OTHER; note = 2'-fluoroadenosine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  source 1..23: mol_type = other RNA
acgcggccatcatagcagcttgc

SEQ ID NO: 822 - RNA, 23 nt, synthetic construct
  modified_base 5: mod_base = OTHER; note = thymine
  modified_base 7: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluorouridine-3'-phosphorothioate
  modified_base 5: mod_base = OTHER; note = 2`-deoxythymidine -3`-phosphate
  modified_base 7: mod_base = OTHER; note = Thymidine-glycol nucleic acid (GNA) S-Isomer
  modified_base 14: mod_base = OTHER; note = 2'-fluorouridine-3'-phosphate
  modified_base 16: mod_base = OTHER; note = 2'-fluoroguanosine-3'-phosphate
  modified_base 21: mod_base = OTHER; note = 2'-O-methyluridine-3'-phosphorothioate
  modified_base 22: mod_base = OTHER; note = 2'-O-methyladenosine-3'- phosphorothioate
  source 1..23: mol_type = other RNA
atgctcttcagctttgtacttat

SEQ ID NO: 823 - RNA, 23 nt, synthetic construct
  modified_base 5: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 5: mod_base = OTHER; note = 2`-deoxythimidine -3`-phosphate
  modified_base 7: mod_base = OTHER; note = Adenosine-glycol nucleic acid (GNA) S-Isomer
  modified_base 14: mod_base = OTHER; note = 2'-fluoroadenosine-3'-phosphate
  modified_base 16: mod_base = OTHER; note = 2'-fluoroguanosine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  source 1..23: mol_type = other RNA
aagctgaggctcaaagcacttct

SEQ ID NO: 824 - RNA, 23 nt, synthetic construct
  modified_base 5: mod_base = OTHER; note = thymine
  modified_base 7: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxycytidine-3`-phosphorothioate
  modified_base 5: mod_base = OTHER; note = 2`-deoxythimidine-3`-phosphate
  modified_base 7: mod_base = OTHER; note = 2`-deoxythimidine-3`-phosphate
  modified_base 12: mod_base = OTHER; note = 2`-deoxyguanosine -3`-phosphate
  modified_base 14: mod_base = OTHER; note = 2'-fluoroadenosine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  source 1..23: mol_type = other RNA
acattttcaaagcactttattga

SEQ ID NO: 825 - RNA, 23 nt, synthetic construct
  modified_base 7: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxyguanosine-3`-phosphorothioate
  modified_base 5: mod_base = OTHER; note = 2`-deoxycytidine-3`-phosphate
  modified_base 7: mod_base = OTHER; note = 2`-deoxythimidine-3`-phosphate
  modified_base 12: mod_base = OTHER; note = 2`-deoxyguanosine -3`-phosphate
  modified_base 14: mod_base = OTHER; note = 2'-fluoroadenosine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  source 1..23: mol_type = other RNA
agcccttgtgggtacatttgtgg

SEQ ID NO: 826 - RNA, 23 nt, synthetic construct
  modified_base 7: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 5: mod_base = OTHER; note = 2`-deoxyadenosine -3`-phosphate
  modified_base 7: mod_base = OTHER; note = Thymidine-glycol nucleic acid (GNA) S-Isomer
  modified_base 14: mod_base = OTHER; note = 2'-fluoroguanosine-3'-phosphate
  modified_base 16: mod_base = OTHER; note = 2'-fluorocytidine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  source 1..23: mol_type = other RNA
agacagtgagaacgactgtgtgc

SEQ ID NO: 827 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 5: mod_base = OTHER; note = 2`-deoxyguanosine -3`-phosphate
  modified_base 7: mod_base = OTHER; note = Adenosine-glycol nucleic acid (GNA) S-Isomer
  modified_base 14: mod_base = OTHER; note = 2'-fluoroadenosine-3'-phosphate
  modified_base 16: mod_base = OTHER; note = 2'-fluorocytidine-3'-phosphate
  modified_base 21: mod_base = OTHER; note = 2'-O-methyluridine-3'-phosphorothioate
  modified_base 22: mod_base = OTHER; note = 2'-O-methyladenosine-3'- phosphorothioate
  source 1..23: mol_type = other RNA
agtagtaggccacatcggtgtag

SEQ ID NO: 828 - RNA, 23 nt, synthetic construct
  modified_base 7: mod_base = OTHER; note = thymine
  modified_base 12: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxycytidine-3`-phosphorothioate
  modified_base 5: mod_base = OTHER; note = 2`-deoxyguanosine-3`-phosphate
  modified_base 7: mod_base = OTHER; note = 2`-deoxythimidine-3`-phosphate
  modified_base 12: mod_base = OTHER; note = 2`-deoxythimidine -3`-phosphate
  modified_base 14: mod_base = OTHER; note = 2'-fluoroguanosine-3'-phosphate
  modified_base 21: mod_base = OTHER; note = 2'-O-methyluridine-3'-phosphorothioate
  modified_base 22: mod_base = OTHER; note = 2'-O-methyluridine-3'- phosphorothioate
  source 1..23: mol_type = other RNA
acaaggtggaatcgaaagtgttg

SEQ ID NO: 829 - RNA, 23 nt, synthetic construct
  modified_base 7: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluorocytidine-3'-phosphorothioate
  modified_base 5: mod_base = OTHER; note = 2`-deoxyguanosine -3`-phosphate
  modified_base 7: mod_base = OTHER; note = Thymidine-glycol nucleic acid (GNA) S-Isomer
  modified_base 14: mod_base = OTHER; note = 2'-fluoroguanosine-3'-phosphate
  modified_base 16: mod_base = OTHER; note = 2'-fluoroadenosine-3'-phosphate
  modified_base 21: mod_base = OTHER; note = 2'-O-methyluridine-3'-phosphorothioate
  modified_base 22: mod_base = OTHER; note = 2'-O-methyluridine-3'- phosphorothioate
  source 1..23: mol_type = other RNA
acaaggtggaatcgaaagtgttg

SEQ ID NO: 830 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 5: mod_base = OTHER; note = 2`-deoxyadenosine -3`-phosphate
  modified_base 7: mod_base = OTHER; note = Adenosine-glycol nucleic acid (GNA) S-Isomer
  modified_base 14: mod_base = OTHER; note = 2'-fluoroadenosine-3'-phosphate
  modified_base 16: mod_base = OTHER; note = 2'-fluoroguanosine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  source 1..23: mol_type = other RNA
agtgacagtgagaacgactgtgt

SEQ ID NO: 831 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxycytidine-3`-phosphorothioate
  modified_base 5: mod_base = OTHER; note = 2`-deoxyguanosine-3`-phosphate
  modified_base 7: mod_base = OTHER; note = 2`-deoxyadenosine-3`-phosphate
  modified_base 12: mod_base = OTHER; note = 2`-deoxyguanosine -3`-phosphate
  modified_base 14: mod_base = OTHER; note = 2'-fluoroguanosine-3'-phosphate
  modified_base 21: mod_base = OTHER; note = 2'-O-methyluridine-3'-phosphorothioate
  modified_base 22: mod_base = OTHER; note = 2'-O-methyladenosine-3'- phosphorothioate
  source 1..23: mol_type = other RNA
accagtacagcgcggcgatgtag

SEQ ID NO: 832 - RNA, 23 nt, synthetic construct
  modified_base 12: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxycytidine-3`-phosphorothioate
  modified_base 5: mod_base = OTHER; note = 2`-deoxyadenosine-3`-phosphate
  modified_base 7: mod_base = OTHER; note = 2`-deoxycytidine-3`-phosphate
  modified_base 12: mod_base = OTHER; note = 2`-deoxythimidine -3`-phosphate
  modified_base 14: mod_base = OTHER; note = 2'-fluoroguanosine-3'-phosphate
  modified_base 21: mod_base = OTHER; note = 2'-O-methyluridine-3'-phosphorothioate
  modified_base 22: mod_base = OTHER; note = 2'-O-methyladenosine-3'- phosphorothioate
  source 1..23: mol_type = other RNA
acagagccaggtcgtgctggtag

SEQ ID NO: 833 - RNA, 23 nt, synthetic construct
  modified_base 7: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 5: mod_base = OTHER; note = 2`-deoxyguanosine -3`-phosphate
  modified_base 7: mod_base = OTHER; note = Thymidine-glycol nucleic acid (GNA) S-Isomer
  modified_base 14: mod_base = OTHER; note = 2'-fluoroguanosine-3'-phosphate
  modified_base 16: mod_base = OTHER; note = 2'-fluorocytidine-3'-phosphate
  modified_base 21: mod_base = OTHER; note = 2'-O-methyluridine-3'-phosphorothioate
  modified_base 22: mod_base = OTHER; note = 2'-O-methyluridine-3'- phosphorothioate
  source 1..23: mol_type = other RNA
agcggatgtcgttgtccgggttc

SEQ ID NO: 834 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxycytidine-3`-phosphorothioate
  modified_base 5: mod_base = OTHER; note = 2`-deoxyadenosine-3`-phosphate
  modified_base 7: mod_base = OTHER; note = 2`-deoxyguanosine-3`-phosphate
  modified_base 12: mod_base = OTHER; note = 2`-deoxycytidine -3`-phosphate
  modified_base 14: mod_base = OTHER; note = 2'-fluorouridine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  source 1..23: mol_type = other RNA
actgatgatgccttgcagggtga

SEQ ID NO: 835 - RNA, 23 nt, synthetic construct
  modified_base 12: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxyguanosine-3`-phosphorothioate
  modified_base 5: mod_base = OTHER; note = 2`-deoxyguanosine-3`-phosphate
  modified_base 7: mod_base = OTHER; note = 2`-deoxycytidine-3`-phosphate
  modified_base 12: mod_base = OTHER; note = 2`-deoxythimidine -3`-phosphate
  modified_base 14: mod_base = OTHER; note = 2'-fluoroguanosine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  source 1..23: mol_type = other RNA
agacgcctggcttgttgcggtca

SEQ ID NO: 836 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxyadenosine-3`-phosphorothioate
  modified_base 5: mod_base = OTHER; note = 2`-deoxyguanosine-3`-phosphate
  modified_base 7: mod_base = OTHER; note = 2`-deoxyguanosine-3`-phosphate
  modified_base 12: mod_base = OTHER; note = 2`-deoxyadenosine -3`-phosphate
  modified_base 14: mod_base = OTHER; note = 2'-fluoroadenosine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  source 1..23: mol_type = other RNA
aaaggcgcaacagagccaggtcg

SEQ ID NO: 837 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluorocytidine-3'-phosphorothioate
  modified_base 5: mod_base = OTHER; note = 2`-deoxyguanosine -3`-phosphate
  modified_base 7: mod_base = OTHER; note = Adenosine-glycol nucleic acid (GNA) S-Isomer
  modified_base 14: mod_base = OTHER; note = 2'-fluorocytidine-3'-phosphate
  modified_base 16: mod_base = OTHER; note = 2'-fluoroguanosine-3'-phosphate
  modified_base 21: mod_base = OTHER; note = 2'-O-methyluridine-3'-phosphorothioate
  modified_base 22: mod_base = OTHER; note = 2'-O-methyladenosine-3'- phosphorothioate
  source 1..23: mol_type = other RNA
acaggcacaccggctgaacgtaa

SEQ ID NO: 838 - RNA, 23 nt, synthetic construct
  modified_base 7: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxycytidine-3`-phosphorothioate
  modified_base 5: mod_base = OTHER; note = 2`-deoxyguanosine-3`-phosphate
  modified_base 7: mod_base = OTHER; note = 2`-deoxythimidine-3`-phosphate
  modified_base 12: mod_base = OTHER; note = 2`-deoxyguanosine -3`-phosphate
  modified_base 14: mod_base = OTHER; note = 2'-fluorocytidine-3'-phosphate
  modified_base 21: mod_base = OTHER; note = 2'-O-methyluridine-3'-phosphorothioate
  modified_base 22: mod_base = OTHER; note = 2'-O-methyladenosine-3'- phosphorothioate
  source 1..23: mol_type = other RNA
accggatccaggccaggtagtag

SEQ ID NO: 839 - RNA, 23 nt, synthetic construct
  modified_base 2: mod_base = OTHER; note = thymine
  modified_base 12: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxythimidine-3`-phosphorothioate
  modified_base 5: mod_base = OTHER; note = 2`-deoxyadenosine-3`-phosphate
  modified_base 7: mod_base = OTHER; note = 2`-deoxyadenosine-3`-phosphate
  modified_base 12: mod_base = OTHER; note = 2`-deoxythimidine -3`-phosphate
  modified_base 14: mod_base = OTHER; note = 2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'- phosphorothioate
  source 1..23: mol_type = other RNA
attcaaagcactttattgagttc

SEQ ID NO: 840 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 5: mod_base = OTHER; note = 2`-deoxyadenosine -3`-phosphate
  modified_base 7: mod_base = OTHER; note = Adenosine-glycol nucleic acid (GNA) S-Isomer
  modified_base 14: mod_base = OTHER; note = 2'-fluorouridine-3'-phosphate
  modified_base 16: mod_base = OTHER; note = 2'-fluorocytidine-3'-phosphate
  modified_base 21: mod_base = OTHER; note = 2'-O-methyluridine-3'-phosphorothioate
  modified_base 22: mod_base = OTHER; note = 2'-O-methyluridine-3'- phosphorothioate
  source 1..23: mol_type = other RNA
agccacagctgcttgctcagttc

SEQ ID NO: 841 - RNA, 23 nt, synthetic construct
  modified_base 7: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 5: mod_base = OTHER; note = 2`-deoxyguanosine -3`-phosphate
  modified_base 7: mod_base = OTHER; note = Thymidine-glycol nucleic acid (GNA) S-Isomer
  modified_base 14: mod_base = OTHER; note = 2'-fluoroadenosine-3'-phosphate
  modified_base 16: mod_base = OTHER; note = 2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'- phosphorothioate
  source 1..23: mol_type = other RNA
agaggctcaaagcacttctcttt

SEQ ID NO: 842 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluorouridine-3'-phosphorothioate
  modified_base 5: mod_base = OTHER; note = 2`-deoxyguanosine -3`-phosphate
  modified_base 7: mod_base = OTHER; note = adenosine-glycol nucleic acid (GNA) S-Isomer
  modified_base 14: mod_base = OTHER; note = 2'-fluorouridine-3'-phosphate
  modified_base 16: mod_base = OTHER; note = 2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'- phosphorothioate
  source 1..23: mol_type = other RNA
atgagaacgactgtgtgctcttc

SEQ ID NO: 843 - RNA, 23 nt, synthetic construct
  modified_base 7: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 5: mod_base = OTHER; note = 2`-deoxycytidine -3`-phosphate
  modified_base 7: mod_base = OTHER; note = Thymidine-glycol nucleic acid (GNA) S-Isomer
  modified_base 14: mod_base = OTHER; note = 2'-fluorocytidine-3'-phosphate
  modified_base 16: mod_base = OTHER; note = 2'-fluoroguanosine-3'-phosphate
  modified_base 21: mod_base = OTHER; note = 2'-O-methyluridine-3'-phosphorothioate
  modified_base 22: mod_base = OTHER; note = 2'-O-methyluridine-3'- phosphorothioate
  source 1..23: mol_type = other RNA
aggtcatcgaagacagactcttg

SEQ ID NO: 844 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxyguanosine-3`-phosphorothioate
  modified_base 5: mod_base = OTHER; note = 2`-deoxycytidine-3`-phosphate
  modified_base 7: mod_base = OTHER; note = 2`-deoxycytidine-3`-phosphate
  modified_base 12: mod_base = OTHER; note = 2`-deoxyadenosine -3`-phosphate
  modified_base 14: mod_base = OTHER; note = 2'-fluorouridine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  source 1..23: mol_type = other RNA
aggacccttgcactggcatctgg

SEQ ID NO: 845 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxycytidine-3`-phosphorothioate
  modified_base 5: mod_base = OTHER; note = 2`-deoxycytidine-3`-phosphate
  modified_base 7: mod_base = OTHER; note = 2`-deoxyguanosine-3`-phosphate
  modified_base 12: mod_base = OTHER; note = 2`-deoxyadenosine -3`-phosphate
  modified_base 14: mod_base = OTHER; note = 2'-fluoroguanosine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  source 1..23: mol_type = other RNA
acaacagagccaggtcgtgctgg

SEQ ID NO: 846 - RNA, 23 nt, synthetic construct
  modified_base 7: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxyadenosine-3`-phosphorothioate
  modified_base 5: mod_base = OTHER; note = 2`-deoxyguanosine-3`-phosphate
  modified_base 7: mod_base = OTHER; note = 2`-deoxythimidine-3`-phosphate
  modified_base 12: mod_base = OTHER; note = 2`-deoxyadenosine -3`-phosphate
  modified_base 14: mod_base = OTHER; note = 2'-fluoroguanosine-3'-phosphate
  modified_base 21: mod_base = OTHER; note = 2'-O-methyluridine-3'-phosphorothioate
  modified_base 22: mod_base = OTHER; note = 2'-O-methyluridine-3'- phosphorothioate
  source 1..23: mol_type = other RNA
aatcggtgtagacgcctggcttg

SEQ ID NO: 847 - RNA, 23 nt, synthetic construct
  modified_base 7: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 5: mod_base = OTHER; note = 2`-deoxyguanosine -3`-phosphate
  modified_base 7: mod_base = OTHER; note = Thymidine-glycol nucleic acid (GNA) S-Isomer
  modified_base 14: mod_base = OTHER; note = 2'-fluoroguanosine-3'-phosphate
  modified_base 16: mod_base = OTHER; note = 2'-fluorocytidine-3'-phosphate
  modified_base 21: mod_base = OTHER; note = 2'-O-methyluridine-3'-phosphorothioate
  modified_base 22: mod_base = OTHER; note = 2'-O-methyluridine-3'- phosphorothioate
  source 1..23: mol_type = other RNA
aatcggtgtagacgcctggcttg

SEQ ID NO: 848 - RNA, 23 nt, synthetic construct
  modified_base 5: mod_base = OTHER; note = thymine
  modified_base 7: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 5: mod_base = OTHER; note = 2`-deoxythimidine -3`-phosphate
  modified_base 7: mod_base = OTHER; note = Thymidine-glycol nucleic acid (GNA) S-Isomer
  modified_base 14: mod_base = OTHER; note = 2'-fluorocytidine-3'-phosphate
  modified_base 16: mod_base = OTHER; note = 2'-fluorouridine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  source 1..23: mol_type = other RNA
agtctttcactttcttgggctcc

SEQ ID NO: 849 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxycytidine-3`-phosphorothioate
  modified_base 5: mod_base = OTHER; note = 2`-deoxycytidine-3`-phosphate
  modified_base 7: mod_base = OTHER; note = 2`-deoxyguanosine-3`-phosphate
  modified_base 12: mod_base = OTHER; note = 2`-deoxycytidine -3`-phosphate
  modified_base 14: mod_base = OTHER; note = 2'-fluorocytidine-3'-phosphate
  modified_base 21: mod_base = OTHER; note = 2'-O-methyluridine-3'-phosphorothioate
  modified_base 22: mod_base = OTHER; note = 2'-O-methyluridine-3'- phosphorothioate
  source 1..23: mol_type = other RNA
acgactgtgtgctcttcagcttt

SEQ ID NO: 850 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxycytidine-3`-phosphorothioate
  modified_base 5: mod_base = OTHER; note = 2`-deoxycytidine-3`-phosphate
  modified_base 7: mod_base = OTHER; note = 2`-deoxyguanosine-3`-phosphate
  modified_base 12: mod_base = OTHER; note = 2`-deoxycytidine -3`-phosphate
  modified_base 14: mod_base = OTHER; note = 2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'- phosphorothioate
  source 1..23: mol_type = other RNA
accgcggccatcatagcagcttg

SEQ ID NO: 851 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 5: mod_base = OTHER; note = 2`-deoxyadenosine -3`-phosphate
  modified_base 7: mod_base = OTHER; note = Adenosine-glycol nucleic acid (GNA) S-Isomer
  modified_base 14: mod_base = OTHER; note = 2'-fluoroguanosine-3'-phosphate
  modified_base 16: mod_base = OTHER; note = 2'-fluoroadenosine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  source 1..23: mol_type = other RNA
aggtacatttgtggtacagctgc

SEQ ID NO: 852 - RNA, 23 nt, synthetic construct
  modified_base 5: mod_base = OTHER; note = thymine
  modified_base 7: mod_base = OTHER; note = thymine
  modified_base 12: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxyadenosine-3`-phosphorothioate
  modified_base 5: mod_base = OTHER; note = 2`-deoxythimidine-3`-phosphate
  modified_base 7: mod_base = OTHER; note = 2`-deoxythimidine-3`-phosphate
  modified_base 12: mod_base = OTHER; note = 2`-deoxythimidine -3`-phosphate
  modified_base 14: mod_base = OTHER; note = 2'-fluoroadenosine-3'-phosphate
  modified_base 21: mod_base = OTHER; note = 2'-O-methyluridine-3'-phosphorothioate
  modified_base 22: mod_base = OTHER; note = 2'-O-methyluridine-3'- phosphorothioate
  source 1..23: mol_type = other RNA
aagctttgtacttatgctccttg

SEQ ID NO: 853 - RNA, 23 nt, synthetic construct
  modified_base 5: mod_base = OTHER; note = thymine
  modified_base 7: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 5: mod_base = OTHER; note = 2`-deoxythymidine -3`-phosphate
  modified_base 7: mod_base = OTHER; note = Thymidine-glycol nucleic acid (GNA) S-Isomer
  modified_base 14: mod_base = OTHER; note = 2'-fluoroadenosine-3'-phosphate
  modified_base 16: mod_base = OTHER; note = 2'-fluoroguanosine-3'-phosphate
  modified_base 21: mod_base = OTHER; note = 2'-O-methyluridine-3'-phosphorothioate
  modified_base 22: mod_base = OTHER; note = 2'-O-methyluridine-3'- phosphorothioate
  source 1..23: mol_type = other RNA
aagctttgtacttatgctccttg

SEQ ID NO: 854 - RNA, 23 nt, synthetic construct
  modified_base 7: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluorouridine-3'-phosphorothioate
  modified_base 5: mod_base = OTHER; note = 2`-deoxyadenosine -3`-phosphate
  modified_base 7: mod_base = OTHER; note = Thymidine-glycol nucleic acid (GNA) S-Isomer
  modified_base 14: mod_base = OTHER; note = 2'-fluoroguanosine-3'-phosphate
  modified_base 16: mod_base = OTHER; note = 2'-fluorocytidine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  source 1..23: mol_type = other RNA
attgagttcctgcgccatcctgg

SEQ ID NO: 855 - RNA, 23 nt, synthetic construct
  modified_base 7: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxycytidine-3`-phosphorothioate
  modified_base 5: mod_base = OTHER; note = 2`-deoxycytidine-3`-phosphate
  modified_base 7: mod_base = OTHER; note = 2`-deoxythimidine-3`-phosphate
  modified_base 12: mod_base = OTHER; note = 2`-deoxyguanosine -3`-phosphate
  modified_base 14: mod_base = OTHER; note = 2'-fluoroadenosine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  source 1..23: mol_type = other RNA
accacatcggtgtagacgcctgg

SEQ ID NO: 856 - RNA, 23 nt, synthetic construct
  modified_base 7: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 5: mod_base = OTHER; note = 2`-deoxyadenosine -3`-phosphate
  modified_base 7: mod_base = OTHER; note = Thymidine-glycol nucleic acid (GNA) S-Isomer
  modified_base 14: mod_base = OTHER; note = 2'-fluorouridine-3'-phosphate
  modified_base 16: mod_base = OTHER; note = 2'-fluoroadenosine-3'-phosphate
  modified_base 21: mod_base = OTHER; note = 2'-O-methyluridine-3'-phosphorothioate
  modified_base 22: mod_base = OTHER; note = 2'-O-methyladenosine-3'- phosphorothioate
  source 1..23: mol_type = other RNA
aatgagtgggacatgaagcctag

SEQ ID NO: 857 - RNA, 23 nt, synthetic construct
  modified_base 2: mod_base = OTHER; note = thymine
  modified_base 7: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxythimidine-3`-phosphorothioate
  modified_base 5: mod_base = OTHER; note = 2`-deoxyadenosine-3`-phosphate
  modified_base 7: mod_base = OTHER; note = 2`-deoxythimidine-3`-phosphate
  modified_base 12: mod_base = OTHER; note = 2`-deoxyadenosine -3`-phosphate
  modified_base 14: mod_base = OTHER; note = 2'-fluorouridine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  source 1..23: mol_type = other RNA
atggaatcgaaagtgttgactcc

SEQ ID NO: 858 - RNA, 23 nt, synthetic construct
  modified_base 7: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluorouridine-3'-phosphorothioate
  modified_base 5: mod_base = OTHER; note = 2`-deoxyadenosine -3`-phosphate
  modified_base 7: mod_base = OTHER; note = Thymidine-glycol nucleic acid (GNA) S-Isomer
  modified_base 14: mod_base = OTHER; note = 2'-fluorouridine-3'-phosphate
  modified_base 16: mod_base = OTHER; note = 2'-fluorouridine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  source 1..23: mol_type = other RNA
atggaatcgaaagtgttgactcc

SEQ ID NO: 859 - RNA, 23 nt, synthetic construct
  modified_base 5: mod_base = OTHER; note = thymine
  modified_base 7: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxyguanosine-3`-phosphorothioate
  modified_base 5: mod_base = OTHER; note = 2`-deoxythimidine-3`-phosphate
  modified_base 7: mod_base = OTHER; note = 2`-deoxythimidine-3`-phosphate
  modified_base 12: mod_base = OTHER; note = 2`-deoxyadenosine -3`-phosphate
  modified_base 14: mod_base = OTHER; note = 2'-fluorocytidine-3'-phosphate
  modified_base 21: mod_base = OTHER; note = 2'-O-methyluridine-3'-phosphorothioate
  modified_base 22: mod_base = OTHER; note = 2'-O-methyluridine-3'- phosphorothioate
  source 1..23: mol_type = other RNA
agcattttcaaagcactttattg

SEQ ID NO: 860 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxyadenosine-3`-phosphorothioate
  modified_base 5: mod_base = OTHER; note = 2`-deoxyadenosine-3`-phosphate
  modified_base 7: mod_base = OTHER; note = 2`-deoxyguanosine-3`-phosphate
  modified_base 12: mod_base = OTHER; note = 2`-deoxyadenosine -3`-phosphate
  modified_base 14: mod_base = OTHER; note = 2'-fluoroguanosine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  source 1..23: mol_type = other RNA
aacgaagcaccacgggcggatgt

SEQ ID NO: 861 - RNA, 23 nt, synthetic construct
  modified_base 7: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluorouridine-3'-phosphorothioate
  modified_base 5: mod_base = OTHER; note = 2`-deoxyguanosine-3`-phosphate
  modified_base 7: mod_base = OTHER; note = Thymidine-glycol nucleic acid (GNA) S-Isomer
  modified_base 14: mod_base = OTHER; note = 2'-fluoroadenosine-3'-phosphate
  modified_base 16: mod_base = OTHER; note = 2'-fluorocytidine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  source 1..23: mol_type = other RNA
atgcggtcaccacagcccgatcc

SEQ ID NO: 862 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxycytidine-3`-phosphorothioate
  modified_base 5: mod_base = OTHER; note = 2`-deoxyguanosine-3`-phosphate
  modified_base 7: mod_base = OTHER; note = 2`-deoxycytidine-3`-phosphate
  modified_base 12: mod_base = OTHER; note = 2`-deoxyguanosine -3`-phosphate
  modified_base 14: mod_base = OTHER; note = 2'-fluoroadenosine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  source 1..23: mol_type = other RNA
acaggacccttgcactggcatct

SEQ ID NO: 863 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxyadenosine-3`-phosphorothioate
  modified_base 5: mod_base = OTHER; note = 2`-deoxyadenosine-3`-phosphate
  modified_base 7: mod_base = OTHER; note = 2`-deoxycytidine-3`-phosphate
  modified_base 12: mod_base = OTHER; note = 2`-deoxycytidine -3`-phosphate
  modified_base 14: mod_base = OTHER; note = 2'-fluorocytidine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  source 1..23: mol_type = other RNA
aaggaaccctgcgcagagcatgc

SEQ ID NO: 864 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxyguanosine-3`-phosphorothioate
  modified_base 5: mod_base = OTHER; note = 2`-deoxyguanosine-3`-phosphate
  modified_base 7: mod_base = OTHER; note = 2`-deoxycytidine-3`-phosphate
  modified_base 12: mod_base = OTHER; note = 2`-deoxyguanosine -3`-phosphate
  modified_base 14: mod_base = OTHER; note = 2'-fluoroguanosine-3'-phosphate
  modified_base 21: mod_base = OTHER; note = 2'-O-methyluridine-3'-phosphorothioate
  modified_base 22: mod_base = OTHER; note = 2'-O-methyluridine-3'- phosphorothioate
  source 1..23: mol_type = other RNA
agccggcccttgtgggtacattt

SEQ ID NO: 865 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxyadenosine-3`-phosphorothioate
  modified_base 5: mod_base = OTHER; note = 2`-deoxyadenosine-3`-phosphate
  modified_base 7: mod_base = OTHER; note = 2`-deoxyguanosine-3`-phosphate
  modified_base 12: mod_base = OTHER; note = 2`-deoxycytidine -3`-phosphate
  modified_base 14: mod_base = OTHER; note = 2'-fluorouridine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  source 1..23: mol_type = other RNA
aaagatgagtccctgagcaatca

SEQ ID NO: 866 - RNA, 23 nt, synthetic construct
  modified_base 5: mod_base = OTHER; note = thymine
  modified_base 7: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluorocytidine-3'-phosphorothioate
  modified_base 5: mod_base = OTHER; note = 2`-deoxythymidine -3`-phosphate
  modified_base 7: mod_base = OTHER; note = Thymidine-glycol nucleic acid (GNA) S-Isomer
  modified_base 14: mod_base = OTHER; note = 2'-fluorocytidine-3'-phosphate
  modified_base 16: mod_base = OTHER; note = 2'-fluoroguanosine-3'-phosphate
  modified_base 21: mod_base = OTHER; note = 2'-O-methylguanosine-3'-phosphorothioate
  modified_base 22: mod_base = OTHER; note = 2'-O-methyluridine-3'- phosphorothioate
  source 1..23: mol_type = other RNA
actgtgtgctcttcagctttgta

SEQ ID NO: 867 - RNA, 23 nt, synthetic construct
  modified_base 7: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 5: mod_base = OTHER; note = 2`-deoxycytidine -3`-phosphate
  modified_base 7: mod_base = OTHER; note = Thymidine-glycol nucleic acid (GNA) S-Isomer
  modified_base 14: mod_base = OTHER; note = 2'-fluorocytidine-3'-phosphate
  modified_base 16: mod_base = OTHER; note = 2'-fluoroguanosine-3'-phosphate
  modified_base 21: mod_base = OTHER; note = 2'-O-methyluridine-3'-phosphorothioate
  modified_base 22: mod_base = OTHER; note = 2'-O-methyluridine-3'- phosphorothioate
  source 1..23: mol_type = other RNA
aggcccttgtgggtacatttgtg

SEQ ID NO: 868 - RNA, 23 nt, synthetic construct
  modified_base 7: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 5: mod_base = OTHER; note = 2`-deoxyguanosine -3`-phosphate
  modified_base 7: mod_base = OTHER; note = Thymidine-glycol nucleic acid (GNA) S-Isomer
  modified_base 14: mod_base = OTHER; note = 2'-fluorocytidine-3'-phosphate
  modified_base 16: mod_base = OTHER; note = 2'-fluorouridine-3'-phosphate
  modified_base 21: mod_base = OTHER; note = 2'-O-methylguanosine-3'-phosphorothioate
  modified_base 22: mod_base = OTHER; note = 2'-O-methylguanosine-3'- phosphorothioate
  source 1..23: mol_type = other RNA
aagtggtctttcactttcttggg

SEQ ID NO: 869 - RNA, 23 nt, synthetic construct
  modified_base 2: mod_base = OTHER; note = thymine
  modified_base 5: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxythimidine-3`-phosphorothioate
  modified_base 5: mod_base = OTHER; note = 2`-deoxythimidine-3`-phosphate
  modified_base 7: mod_base = OTHER; note = 2`-deoxyguanosine-3`-phosphate
  modified_base 12: mod_base = OTHER; note = 2`-deoxycytidine -3`-phosphate
  modified_base 14: mod_base = OTHER; note = 2'-fluoroguanosine-3'-phosphate
  modified_base 21: mod_base = OTHER; note = 2'-O-methylguanosine-3'-phosphorothioate
  modified_base 22: mod_base = OTHER; note = 2'-O-methylcytidine-3'- phosphorothioate
  source 1..23: mol_type = other RNA
atcatcgaagacagactcttgcg

SEQ ID NO: 870 - RNA, 23 nt, synthetic construct
  modified_base 5: mod_base = OTHER; note = thymine
  modified_base 7: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluorocytidine-3'-phosphorothioate
  modified_base 5: mod_base = OTHER; note = 2`-deoxythymidine -3`-phosphate
  modified_base 7: mod_base = OTHER; note = Thymidine-glycol nucleic acid (GNA) S-Isomer
  modified_base 14: mod_base = OTHER; note = 2'-fluoroguanosine-3'-phosphate
  modified_base 16: mod_base = OTHER; note = 2'-fluorouridine-3'-phosphate
  modified_base 21: mod_base = OTHER; note = 2'-O-methylguanosine-3'-phosphorothioate
  modified_base 22: mod_base = OTHER; note = 2'-O-methylguanosine-3'- phosphorothioate
  source 1..23: mol_type = other RNA
actttgtacttatgctccttggg

SEQ ID NO: 871 - RNA, 23 nt, synthetic construct
  modified_base 5: mod_base = OTHER; note = thymine
  modified_base 12: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxycytidine-3`-phosphorothioate
  modified_base 5: mod_base = OTHER; note = 2`-deoxythimidine-3`-phosphate
  modified_base 7: mod_base = OTHER; note = 2`-deoxyguanosine-3`-phosphate
  modified_base 12: mod_base = OTHER; note = 2`-deoxythimidine -3`-phosphate
  modified_base 14: mod_base = OTHER; note = 2'-fluorocytidine-3'-phosphate
  modified_base 21: mod_base = OTHER; note = 2'-O-methylguanosine-3'-phosphorothioate
  modified_base 22: mod_base = OTHER; note = 2'-O-methylguanosine-3'- phosphorothioate
  source 1..23: mol_type = other RNA
acccttgtgggtacatttgtggt

SEQ ID NO: 872 - RNA, 23 nt, synthetic construct
  modified_base 5: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluorouridine-3'-phosphorothioate
  modified_base 5: mod_base = OTHER; note = 2`-deoxythymidine-3`-phosphate
  modified_base 7: mod_base = OTHER; note = adenosine-glycol nucleic acid (GNA) S-Isomer
  modified_base 14: mod_base = OTHER; note = 2'-fluoroguanosine-3'-phosphate
  modified_base 16: mod_base = OTHER; note = 2'-fluoroadenosine-3'-phosphate
  modified_base 21: mod_base = OTHER; note = 2'-O-methylguanosine-3'-phosphorothioate
  modified_base 22: mod_base = OTHER; note = 2'-O-methyladenosine-3'- phosphorothioate
  source 1..23: mol_type = other RNA
atgatgatgccttgcagggtgag

SEQ ID NO: 873 - RNA, 23 nt, synthetic construct
  modified_base 7: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 5: mod_base = OTHER; note = 2`-deoxyadenosine -3`-phosphate
  modified_base 7: mod_base = OTHER; note = Thymidine-glycol nucleic acid (GNA) S-Isomer
  modified_base 14: mod_base = OTHER; note = 2'-fluorocytidine-3'-phosphate
  modified_base 16: mod_base = OTHER; note = 2'-fluorouridine-3'-phosphate
  modified_base 21: mod_base = OTHER; note = 2'-O-methylguanosine-3'-phosphorothioate
  modified_base 22: mod_base = OTHER; note = 2'-O-methyluridine-3'- phosphorothioate
  source 1..23: mol_type = other RNA
aggtagtaggccacatcggtgta

SEQ ID NO: 874 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxycytidine-3`-phosphorothioate
  modified_base 5: mod_base = OTHER; note = 2`-deoxyadenosine-3`-phosphate
  modified_base 7: mod_base = OTHER; note = 2`-deoxycytidine-3`-phosphate
  modified_base 12: mod_base = OTHER; note = 2`-deoxycytidine -3`-phosphate
  modified_base 14: mod_base = OTHER; note = 2'-fluoroadenosine-3'-phosphate
  modified_base 21: mod_base = OTHER; note = 2'-O-methylguanosine-3'-phosphorothioate
  modified_base 22: mod_base = OTHER; note = 2'-O-methylcytidine-3'- phosphorothioate
  source 1..23: mol_type = other RNA
acgcaacagagccaggtcgtgct

SEQ ID NO: 875 - RNA, 23 nt, synthetic construct
  modified_base 5: mod_base = OTHER; note = thymine
  modified_base 7: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluorouridine-3'-phosphorothioate
  modified_base 5: mod_base = OTHER; note = 2`-deoxythymidine-3`-phosphate
  modified_base 7: mod_base = OTHER; note = Thymidine-glycol nucleic acid (GNA) S-Isomer
  modified_base 14: mod_base = OTHER; note = 2'-fluoroadenosine-3'-phosphate
  modified_base 16: mod_base = OTHER; note = 2'-fluoroadenosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'- phosphorothioate
  source 1..23: mol_type = other RNA
atgttgtggacagagacagtggg

SEQ ID NO: 876 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxycytidine-3`-phosphorothioate
  modified_base 5: mod_base = OTHER; note = 2`-deoxyadenosine-3`-phosphate
  modified_base 7: mod_base = OTHER; note = 2`-deoxyguanosine-3`-phosphate
  modified_base 12: mod_base = OTHER; note = 2`-deoxyadenosine -3`-phosphate
  modified_base 14: mod_base = OTHER; note = 2'-fluorocytidine-3'-phosphate
  modified_base 21: mod_base = OTHER; note = 2'-O-methylguanosine-3'-phosphorothioate
  modified_base 22: mod_base = OTHER; note = 2'-O-methyluridine-3'- phosphorothioate
  source 1..23: mol_type = other RNA
accaaggtggaatcgaaagtgtt

SEQ ID NO: 877 - RNA, 23 nt, synthetic construct
  modified_base 7: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 5: mod_base = OTHER; note = 2`-deoxycytidine -3`-phosphate
  modified_base 7: mod_base = OTHER; note = Thymidine-glycol nucleic acid (GNA) S-Isomer
  modified_base 14: mod_base = OTHER; note = 2'-fluoroguanosine-3'-phosphate
  modified_base 16: mod_base = OTHER; note = 2'-fluorocytidine-3'-phosphate
  modified_base 21: mod_base = OTHER; note = 2'-O-methylguanosine-3'-phosphorothioate
  modified_base 22: mod_base = OTHER; note = 2'-O-methylguanosine-3'- phosphorothioate
  source 1..23: mol_type = other RNA
agacccttgcactggcatctggc

SEQ ID NO: 878 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 5: mod_base = OTHER; note = 2`-deoxyadenosine -3`-phosphate
  modified_base 7: mod_base = OTHER; note = Adenosine-glycol nucleic acid (GNA) S-Isomer
  modified_base 14: mod_base = OTHER; note = 2'-fluorouridine-3'-phosphate
  modified_base 16: mod_base = OTHER; note = 2'-fluoroguanosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'- phosphorothioate
  source 1..23: mol_type = other RNA
aaacagagccaggtcgtgctggt

SEQ ID NO: 879 - RNA, 23 nt, synthetic construct
  modified_base 7: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxyguanosine-3`-phosphorothioate
  modified_base 5: mod_base = OTHER; note = 2`-deoxycytidine-3`-phosphate
  modified_base 7: mod_base = OTHER; note = 2`-deoxythimidine-3`-phosphate
  modified_base 12: mod_base = OTHER; note = 2`-deoxyguanosine -3`-phosphate
  modified_base 14: mod_base = OTHER; note = 2'-fluorouridine-3'-phosphate
  modified_base 21: mod_base = OTHER; note = 2'-O-methylguanosine-3'-phosphorothioate
  modified_base 22: mod_base = OTHER; note = 2'-O-methylcytidine-3'- phosphorothioate
  source 1..23: mol_type = other RNA
agtacatttgtggtacagctgcc

SEQ ID NO: 880 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluorocytidine-3'-phosphorothioate
  modified_base 5: mod_base = OTHER; note = 2`-deoxyguanosine -3`-phosphate
  modified_base 7: mod_base = OTHER; note = Adenosine-glycol nucleic acid (GNA) S-Isomer
  modified_base 14: mod_base = OTHER; note = 2'-fluorocytidine-3'-phosphate
  modified_base 16: mod_base = OTHER; note = 2'-fluorocytidine-3'-phosphate
  modified_base 21: mod_base = OTHER; note = 2'-O-methylguanosine-3'-phosphorothioate
  modified_base 22: mod_base = OTHER; note = 2'-O-methylcytidine-3'- phosphorothioate
  source 1..23: mol_type = other RNA
actggcatctggccacagctgct

SEQ ID NO: 881 - RNA, 23 nt, synthetic construct
  modified_base 7: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 5: mod_base = OTHER; note = 2`-deoxyadenosine -3`-phosphate
  modified_base 7: mod_base = OTHER; note = Thymidine-glycol nucleic acid (GNA) S-Isomer
  modified_base 14: mod_base = OTHER; note = 2'-fluoroadenosine-3'-phosphate
  modified_base 16: mod_base = OTHER; note = 2'-fluorouridine-3'-phosphate
  modified_base 21: mod_base = OTHER; note = 2'-O-methylguanosine-3'-phosphorothioate
  modified_base 22: mod_base = OTHER; note = 2'-O-methylcytidine-3'- phosphorothioate
  source 1..23: mol_type = other RNA
aagcactttattgagttcctgcg

SEQ ID NO: 882 - RNA, 23 nt, synthetic construct
  modified_base 7: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluorouridine-3'-phosphorothioate
  modified_base 5: mod_base = OTHER; note = 2`-deoxyguanosine-3`-phosphate
  modified_base 7: mod_base = OTHER; note = Thymidine-glycol nucleic acid (GNA) S-Isomer
  modified_base 14: mod_base = OTHER; note = 2'-fluorocytidine-3'-phosphate
  modified_base 16: mod_base = OTHER; note = 2'-fluoroadenosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'- phosphorothioate
  source 1..23: mol_type = other RNA
atgagttcctgcgccatcctggc

SEQ ID NO: 883 - RNA, 23 nt, synthetic construct
  modified_base 12: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxycytidine-3`-phosphorothioate
  modified_base 5: mod_base = OTHER; note = 2`-deoxyadenosine-3`-phosphate
  modified_base 7: mod_base = OTHER; note = 2`-deoxycytidine-3`-phosphate
  modified_base 12: mod_base = OTHER; note = 2`-deoxythimidine -3`-phosphate
  modified_base 14: mod_base = OTHER; note = 2'-fluoroguanosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'- phosphorothioate
  source 1..23: mol_type = other RNA
acacatcggtgtagacgcctggc

SEQ ID NO: 884 - RNA, 23 nt, synthetic construct
  modified_base 12: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxyguanosine-3`-phosphorothioate
  modified_base 5: mod_base = OTHER; note = 2`-deoxyguanosine-3`-phosphate
  modified_base 7: mod_base = OTHER; note = 2`-deoxyadenosine-3`-phosphate
  modified_base 12: mod_base = OTHER; note = 2`-deoxythimidine -3`-phosphate
  modified_base 14: mod_base = OTHER; note = 2'-fluoroadenosine-3'-phosphate
  modified_base 21: mod_base = OTHER; note = 2'-O-methylguanosine-3'-phosphorothioate
  modified_base 22: mod_base = OTHER; note = 2'-O-methyladenosine-3'- phosphorothioate
  source 1..23: mol_type = other RNA
agagggaaagatgagtccctgag

SEQ ID NO: 885 - RNA, 23 nt, synthetic construct
  modified_base 5: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 5: mod_base = OTHER; note = 2`-deoxythimidine -3`-phosphate
  modified_base 7: mod_base = OTHER; note = Adenosine-glycol nucleic acid (GNA) S-Isomer
  modified_base 14: mod_base = OTHER; note = 2'-fluorouridine-3'-phosphate
  modified_base 16: mod_base = OTHER; note = 2'-fluoroguanosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'- phosphorothioate
  source 1..23: mol_type = other RNA
agcatcaggacccttgcactggc

SEQ ID NO: 886 - RNA, 23 nt, synthetic construct
  modified_base 5: mod_base = OTHER; note = thymine
  modified_base 7: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxycytidine-3`-phosphorothioate
  modified_base 5: mod_base = OTHER; note = 2`-deoxythimidine-3`-phosphate
  modified_base 7: mod_base = OTHER; note = 2`-deoxythimidine-3`-phosphate
  modified_base 12: mod_base = OTHER; note = 2`-deoxyadenosine -3`-phosphate
  modified_base 14: mod_base = OTHER; note = 2'-fluoroadenosine-3'-phosphate
  modified_base 21: mod_base = OTHER; note = 2'-O-methylguanosine-3'-phosphorothioate
  modified_base 22: mod_base = OTHER; note = 2'-O-methyluridine-3'- phosphorothioate
  source 1..23: mol_type = other RNA
accttgtgggtacatttgtggta

SEQ ID NO: 887 - RNA, 23 nt, synthetic construct
  modified_base 5: mod_base = OTHER; note = thymine
  modified_base 7: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluorocytidine-3'-phosphorothioate
  modified_base 5: mod_base = OTHER; note = 2`-deoxythymidine -3`-phosphate
  modified_base 7: mod_base = OTHER; note = Thymidine-glycol nucleic acid (GNA) S-Isomer
  modified_base 14: mod_base = OTHER; note = 2'-fluoroadenosine-3'-phosphate
  modified_base 16: mod_base = OTHER; note = 2'-fluorouridine-3'-phosphate
  modified_base 21: mod_base = OTHER; note = 2'-O-methylguanosine-3'-phosphorothioate
  modified_base 22: mod_base = OTHER; note = 2'-O-methyluridine-3'- phosphorothioate
  source 1..23: mol_type = other RNA
accttgtgggtacatttgtggta

SEQ ID NO: 888 - RNA, 23 nt, synthetic construct
  modified_base 7: mod_base = OTHER; note = thymine
  modified_base 12: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxyadenosine-3`-phosphorothioate
  modified_base 5: mod_base = OTHER; note = 2`-deoxycytidine-3`-phosphate
  modified_base 7: mod_base = OTHER; note = 2`-deoxythimidine-3`-phosphate
  modified_base 12: mod_base = OTHER; note = 2`-deoxythimidine -3`-phosphate
  modified_base 14: mod_base = OTHER; note = 2'-fluoroguanosine-3'-phosphate
  modified_base 21: mod_base = OTHER; note = 2'-O-methylguanosine-3'-phosphorothioate
  modified_base 22: mod_base = OTHER; note = 2'-O-methylcytidine-3'- phosphorothioate
  source 1..23: mol_type = other RNA
aacccttgcactggcatctggcc

SEQ ID NO: 889 - RNA, 23 nt, synthetic construct
  modified_base 5: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxyadenosine-3`-phosphorothioate
  modified_base 5: mod_base = OTHER; note = 2`-deoxythimidine-3`-phosphate
  modified_base 7: mod_base = OTHER; note = 2`-deoxyguanosine-3`-phosphate
  modified_base 12: mod_base = OTHER; note = 2`-deoxyadenosine -3`-phosphate
  modified_base 14: mod_base = OTHER; note = 2'-fluoroadenosine-3'-phosphate
  modified_base 21: mod_base = OTHER; note = 2'-O-methylguanosine-3'-phosphorothioate
  modified_base 22: mod_base = OTHER; note = 2'-O-methylcytidine-3'- phosphorothioate
  source 1..23: mol_type = other RNA
aacatcggtgtagacgcctggct

SEQ ID NO: 890 - RNA, 23 nt, synthetic construct
  modified_base 5: mod_base = OTHER; note = thymine
  modified_base 7: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluorouridine-3'-phosphorothioate
  modified_base 5: mod_base = OTHER; note = 2`-deoxythymidine-3`-phosphate
  modified_base 7: mod_base = OTHER; note = Thymidine-glycol nucleic acid (GNA) S-Isomer
  modified_base 14: mod_base = OTHER; note = 2'-fluorouridine-3'-phosphate
  modified_base 16: mod_base = OTHER; note = 2'-fluorocytidine-3'-phosphate
  modified_base 21: mod_base = OTHER; note = 2'-O-methylguanosine-3'-phosphorothioate
  modified_base 22: mod_base = OTHER; note = 2'-O-methylcytidine-3'- phosphorothioate
  source 1..23: mol_type = other RNA
atggtctttcactttcttgggct

SEQ ID NO: 891 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxyguanosine-3`-phosphorothioate
  modified_base 5: mod_base = OTHER; note = 2`-deoxyguanosine-3`-phosphate
  modified_base 7: mod_base = OTHER; note = 2`-deoxyadenosine-3`-phosphate
  modified_base 12: mod_base = OTHER; note = 2`-deoxyguanosine -3`-phosphate
  modified_base 14: mod_base = OTHER; note = 2'-fluorouridine-3'-phosphate
  modified_base 21: mod_base = OTHER; note = 2'-O-methylguanosine-3'-phosphorothioate
  modified_base 22: mod_base = OTHER; note = 2'-O-methyluridine-3'- phosphorothioate
  source 1..23: mol_type = other RNA
aggcggatgtcgttgtccgggtt

SEQ ID NO: 892 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 5: mod_base = OTHER; note = 2`-deoxyguanosine -3`-phosphate
  modified_base 7: mod_base = OTHER; note = Adenosine-glycol nucleic acid (GNA) S-Isomer
  modified_base 14: mod_base = OTHER; note = 2'-fluorouridine-3'-phosphate
  modified_base 16: mod_base = OTHER; note = 2'-fluorouridine-3'-phosphate
  modified_base 21: mod_base = OTHER; note = 2'-O-methylguanosine-3'-phosphorothioate
  modified_base 22: mod_base = OTHER; note = 2'-O-methyluridine-3'- phosphorothioate
  source 1..23: mol_type = other RNA
aggcggatgtcgttgtccgggtt

SEQ ID NO: 893 - RNA, 23 nt, synthetic construct
  modified_base 7: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 5: mod_base = OTHER; note = 2`-deoxyguanosine -3`-phosphate
  modified_base 7: mod_base = OTHER; note = Thymidine-glycol nucleic acid (GNA) S-Isomer
  modified_base 14: mod_base = OTHER; note = 2'-fluorouridine-3'-phosphate
  modified_base 16: mod_base = OTHER; note = 2'-fluoroguanosine-3'-phosphate
  modified_base 21: mod_base = OTHER; note = 2'-O-methylguanosine-3'-phosphorothioate
  modified_base 22: mod_base = OTHER; note = 2'-O-methyluridine-3'- phosphorothioate
  source 1..23: mol_type = other RNA
agctgatgatgccttgcagggtg

SEQ ID NO: 894 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxycytidine-3`-phosphorothioate
  modified_base 5: mod_base = OTHER; note = 2`-deoxyguanosine-3`-phosphate
  modified_base 7: mod_base = OTHER; note = 2`-deoxyadenosine-3`-phosphate
  modified_base 12: mod_base = OTHER; note = 2`-deoxyguanosine -3`-phosphate
  modified_base 14: mod_base = OTHER; note = 2'-fluorocytidine-3'-phosphate
  modified_base 21: mod_base = OTHER; note = 2'-O-methylguanosine-3'-phosphorothioate
  modified_base 22: mod_base = OTHER; note = 2'-O-methyluridine-3'- phosphorothioate
  source 1..23: mol_type = other RNA
acaggtagtaggccacatcggtg

SEQ ID NO: 895 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxyadenosine-3`-phosphorothioate
  modified_base 5: mod_base = OTHER; note = 2`-deoxycytidine-3`-phosphate
  modified_base 7: mod_base = OTHER; note = 2`-deoxycytidine-3`-phosphate
  modified_base 12: mod_base = OTHER; note = 2`-deoxycytidine -3`-phosphate
  modified_base 14: mod_base = OTHER; note = 2'-fluorouridine-3'-phosphate
  modified_base 21: mod_base = OTHER; note = 2'-O-methylguanosine-3'-phosphorothioate
  modified_base 22: mod_base = OTHER; note = 2'-O-methyluridine-3'- phosphorothioate
  source 1..23: mol_type = other RNA
aagacgcctggcttgttgcggtc

SEQ ID NO: 896 - RNA, 23 nt, synthetic construct
  modified_base 2: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxythimidine-3`-phosphorothioate
  modified_base 5: mod_base = OTHER; note = 2`-deoxyadenosine-3`-phosphate
  modified_base 7: mod_base = OTHER; note = 2`-deoxyguanosine-3`-phosphate
  modified_base 12: mod_base = OTHER; note = 2`-deoxyadenosine -3`-phosphate
  modified_base 14: mod_base = OTHER; note = 2'-fluorouridine-3'-phosphate
  modified_base 21: mod_base = OTHER; note = 2'-O-methylguanosine-3'-phosphorothioate
  modified_base 22: mod_base = OTHER; note = 2'-O-methyladenosine-3'- phosphorothioate
  source 1..23: mol_type = other RNA
atcgaagacagactcttgcggag

SEQ ID NO: 897 - RNA, 23 nt, synthetic construct
  modified_base 2: mod_base = OTHER; note = thymine
  modified_base 7: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxythimidine-3`-phosphorothioate
  modified_base 5: mod_base = OTHER; note = 2`-deoxycytidine-3`-phosphate
  modified_base 7: mod_base = OTHER; note = 2`-deoxythimidine-3`-phosphate
  modified_base 12: mod_base = OTHER; note = 2`-deoxycytidine -3`-phosphate
  modified_base 14: mod_base = OTHER; note = 2'-fluoroguanosine-3'-phosphate
  modified_base 21: mod_base = OTHER; note = 2'-O-methylguanosine-3'-phosphorothioate
  modified_base 22: mod_base = OTHER; note = 2'-O-methylcytidine-3'- phosphorothioate
  source 1..23: mol_type = other RNA
atgtcgttgtccgggttccggca

SEQ ID NO: 898 - RNA, 23 nt, synthetic construct
  modified_base 7: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluorouridine-3'-phosphorothioate
  modified_base 5: mod_base = OTHER; note = 2`-deoxycytidine-3`-phosphate
  modified_base 7: mod_base = OTHER; note = Thymidine-glycol nucleic acid (GNA) S-Isomer
  modified_base 14: mod_base = OTHER; note = 2'-fluoroguanosine-3'-phosphate
  modified_base 16: mod_base = OTHER; note = 2'-fluorouridine-3'-phosphate
  modified_base 21: mod_base = OTHER; note = 2'-O-methylguanosine-3'-phosphorothioate
  modified_base 22: mod_base = OTHER; note = 2'-O-methylcytidine-3'- phosphorothioate
  source 1..23: mol_type = other RNA
atgtcgttgtccgggttccggca

SEQ ID NO: 899 - RNA, 23 nt, synthetic construct
  modified_base 7: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 5: mod_base = OTHER; note = 2`-deoxycytidine -3`-phosphate
  modified_base 7: mod_base = OTHER; note = Thymidine-glycol nucleic acid (GNA) S-Isomer
  modified_base 14: mod_base = OTHER; note = 2'-fluorocytidine-3'-phosphate
  modified_base 16: mod_base = OTHER; note = 2'-fluorouridine-3'-phosphate
  modified_base 21: mod_base = OTHER; note = 2'-O-methylguanosine-3'-phosphorothioate
  modified_base 22: mod_base = OTHER; note = 2'-O-methyladenosine-3'- phosphorothioate
  source 1..23: mol_type = other RNA
agtacctgcgcctcctgcaggaa

SEQ ID NO: 900 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxyguanosine-3`-phosphorothioate
  modified_base 5: mod_base = OTHER; note = 2`-deoxyguanosine-3`-phosphate
  modified_base 7: mod_base = OTHER; note = 2`-deoxyadenosine-3`-phosphate
  modified_base 12: mod_base = OTHER; note = 2`-deoxyadenosine -3`-phosphate
  modified_base 14: mod_base = OTHER; note = 2'-fluoroguanosine-3'-phosphate
  modified_base 21: mod_base = OTHER; note = 2'-O-methylguanosine-3'-phosphorothioate
  modified_base 22: mod_base = OTHER; note = 2'-O-methyladenosine-3'- phosphorothioate
  source 1..23: mol_type = other RNA
agctgaacgtaaggcgacaggag

SEQ ID NO: 901 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 5: mod_base = OTHER; note = 2`-deoxyguanosine -3`-phosphate
  modified_base 7: mod_base = OTHER; note = Adenosine-glycol nucleic acid (GNA) S-Isomer
  modified_base 14: mod_base = OTHER; note = 2'-fluoroguanosine-3'-phosphate
  modified_base 16: mod_base = OTHER; note = 2'-fluoroguanosine-3'-phosphate
  modified_base 21: mod_base = OTHER; note = 2'-O-methylguanosine-3'-phosphorothioate
  modified_base 22: mod_base = OTHER; note = 2'-O-methyladenosine-3'- phosphorothioate
  source 1..23: mol_type = other RNA
agctgaacgtaaggcgacaggag

SEQ ID NO: 902 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxycytidine-3`-phosphorothioate
  modified_base 5: mod_base = OTHER; note = 2`-deoxyadenosine-3`-phosphate
  modified_base 7: mod_base = OTHER; note = 2`-deoxycytidine-3`-phosphate
  modified_base 12: mod_base = OTHER; note = 2`-deoxyguanosine -3`-phosphate
  modified_base 14: mod_base = OTHER; note = 2'-fluoroadenosine-3'-phosphate
  modified_base 21: mod_base = OTHER; note = 2'-O-methylguanosine-3'-phosphorothioate
  modified_base 22: mod_base = OTHER; note = 2'-O-methylcytidine-3'- phosphorothioate
  source 1..23: mol_type = other RNA
acacaccggctgaacgtaaggcg

SEQ ID NO: 903 - RNA, 23 nt, synthetic construct
  modified_base 2: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxythimidine-3`-phosphorothioate
  modified_base 5: mod_base = OTHER; note = 2`-deoxyadenosine-3`-phosphate
  modified_base 7: mod_base = OTHER; note = 2`-deoxyguanosine-3`-phosphate
  modified_base 12: mod_base = OTHER; note = 2`-deoxyguanosine -3`-phosphate
  modified_base 14: mod_base = OTHER; note = 2'-fluorouridine-3'-phosphate
  modified_base 21: mod_base = OTHER; note = 2'-O-methylguanosine-3'-phosphorothioate
  modified_base 22: mod_base = OTHER; note = 2'-O-methylguanosine-3'- phosphorothioate
  source 1..23: mol_type = other RNA
atagacgcctggcttgttgcggt

SEQ ID NO: 904 - RNA, 23 nt, synthetic construct
  modified_base 5: mod_base = OTHER; note = thymine
  modified_base 7: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxycytidine-3`-phosphorothioate
  modified_base 5: mod_base = OTHER; note = 2`-deoxythimidine-3`-phosphate
  modified_base 7: mod_base = OTHER; note = 2`-deoxythimidine-3`-phosphate
  modified_base 12: mod_base = OTHER; note = 2`-deoxyadenosine -3`-phosphate
  modified_base 14: mod_base = OTHER; note = 2'-fluorouridine-3'-phosphate
  modified_base 21: mod_base = OTHER; note = 2'-O-methylguanosine-3'-phosphorothioate
  modified_base 22: mod_base = OTHER; note = 2'-O-methylcytidine-3'- phosphorothioate
  source 1..23: mol_type = other RNA
acactttattgagttcctgcgcc

SEQ ID NO: 905 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxycytidine-3`-phosphorothioate
  modified_base 5: mod_base = OTHER; note = 2`-deoxycytidine-3`-phosphate
  modified_base 7: mod_base = OTHER; note = 2`-deoxyguanosine-3`-phosphate
  modified_base 12: mod_base = OTHER; note = 2`-deoxyadenosine -3`-phosphate
  modified_base 14: mod_base = OTHER; note = 2'-fluoroguanosine-3'-phosphate
  modified_base 21: mod_base = OTHER; note = 2'-O-methylguanosine-3'-phosphorothioate
  modified_base 22: mod_base = OTHER; note = 2'-O-methyladenosine-3'- phosphorothioate
  source 1..23: mol_type = other RNA
acaccggctgaacgtaaggcgac

SEQ ID NO: 906 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxyadenosine-3`-phosphorothioate
  modified_base 5: mod_base = OTHER; note = 2`-deoxyguanosine-3`-phosphate
  modified_base 7: mod_base = OTHER; note = 2`-deoxyadenosine-3`-phosphate
  modified_base 12: mod_base = OTHER; note = 2`-deoxyguanosine -3`-phosphate
  modified_base 14: mod_base = OTHER; note = 2'-fluorocytidine-3'-phosphate
  modified_base 21: mod_base = OTHER; note = 2'-O-methylguanosine-3'-phosphorothioate
  modified_base 22: mod_base = OTHER; note = 2'-O-methylcytidine-3'- phosphorothioate
  source 1..23: mol_type = other RNA
aaacgtaaggcgacaggagcgcg

SEQ ID NO: 907 - RNA, 23 nt, synthetic construct
  modified_base 5: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxyadenosine-3`-phosphorothioate
  modified_base 5: mod_base = OTHER; note = 2`-deoxythimidine-3`-phosphate
  modified_base 7: mod_base = OTHER; note = 2`-deoxyguanosine-3`-phosphate
  modified_base 12: mod_base = OTHER; note = 2`-deoxycytidine -3`-phosphate
  modified_base 14: mod_base = OTHER; note = 2'-fluoroguanosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'- phosphorothioate
  source 1..23: mol_type = other RNA
aatgtcgttgtccgggttccggc

SEQ ID NO: 908 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 5: mod_base = OTHER; note = 2`-deoxyadenosine -3`-phosphate
  modified_base 7: mod_base = OTHER; note = Adenosine-glycol nucleic acid (GNA) S-Isomer
  modified_base 14: mod_base = OTHER; note = 2'-fluorocytidine-3'-phosphate
  modified_base 16: mod_base = OTHER; note = 2'-fluoroguanosine-3'-phosphate
  modified_base 21: mod_base = OTHER; note = 2'-O-methylguanosine-3'-phosphorothioate
  modified_base 22: mod_base = OTHER; note = 2'-O-methylcytidine-3'- phosphorothioate
  source 1..23: mol_type = other RNA
agacagactcttgcggagccgct

SEQ ID NO: 909 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 5: mod_base = OTHER; note = 2`-deoxycytidine -3`-phosphate
  modified_base 7: mod_base = OTHER; note = Adenosine-glycol nucleic acid (GNA) S-Isomer
  modified_base 14: mod_base = OTHER; note = 2'-fluorouridine-3'-phosphate
  modified_base 16: mod_base = OTHER; note = 2'-fluorouridine-3'-phosphate
  modified_base 21: mod_base = OTHER; note = 2'-O-methylguanosine-3'-phosphorothioate
  modified_base 22: mod_base = OTHER; note = 2'-O-methylcytidine-3'- phosphorothioate
  source 1..23: mol_type = other RNA
aaggccacatcggtgtagacgcc

SEQ ID NO: 910 - RNA, 23 nt, synthetic construct
  modified_base 2: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxythimidine-3`-phosphorothioate
  modified_base 5: mod_base = OTHER; note = 2`-deoxyguanosine-3`-phosphate
  modified_base 7: mod_base = OTHER; note = 2`-deoxyadenosine-3`-phosphate
  modified_base 12: mod_base = OTHER; note = 2`-deoxycytidine -3`-phosphate
  modified_base 14: mod_base = OTHER; note = 2'-fluorocytidine-3'-phosphate
  modified_base 21: mod_base = OTHER; note = 2'-O-methylguanosine-3'-phosphorothioate
  modified_base 22: mod_base = OTHER; note = 2'-O-methylcytidine-3'- phosphorothioate
  source 1..23: mol_type = other RNA
atccggaatcaccctggcacgca

SEQ ID NO: 911 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 5: mod_base = OTHER; note = 2`-deoxyadenosine -3`-phosphate
  modified_base 7: mod_base = OTHER; note = Adenosine-glycol nucleic acid (GNA) S-Isomer
  modified_base 14: mod_base = OTHER; note = 2'-fluorocytidine-3'-phosphate
  modified_base 16: mod_base = OTHER; note = 2'-fluoroadenosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'- phosphorothioate
  source 1..23: mol_type = other RNA
aagtacagcgcggcgatgtaggg

SEQ ID NO: 912 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxycytidine-3`-phosphorothioate
  modified_base 5: mod_base = OTHER; note = 2`-deoxyguanosine-3`-phosphate
  modified_base 7: mod_base = OTHER; note = 2`-deoxyadenosine-3`-phosphate
  modified_base 12: mod_base = OTHER; note = 2`-deoxyguanosine -3`-phosphate
  modified_base 14: mod_base = OTHER; note = 2'-fluorocytidine-3'-phosphate
  modified_base 21: mod_base = OTHER; note = 2'-O-methylguanosine-3'-phosphorothioate
  modified_base 22: mod_base = OTHER; note = 2'-O-methyluridine-3'- phosphorothioate
  source 1..23: mol_type = other RNA
acccggatccaggccaggtagta

SEQ ID NO: 913 - RNA, 23 nt, synthetic construct
  modified_base 2: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxythimidine-3`-phosphorothioate
  modified_base 5: mod_base = OTHER; note = 2`-deoxycytidine-3`-phosphate
  modified_base 7: mod_base = OTHER; note = 2`-deoxyadenosine-3`-phosphate
  modified_base 12: mod_base = OTHER; note = 2`-deoxycytidine -3`-phosphate
  modified_base 14: mod_base = OTHER; note = 2'-fluorouridine-3'-phosphate
  modified_base 21: mod_base = OTHER; note = 2'-O-methylguanosine-3'-phosphorothioate
  modified_base 22: mod_base = OTHER; note = 2'-O-methyluridine-3'- phosphorothioate
  source 1..23: mol_type = other RNA
atttcaaagcactttattgagtt

SEQ ID NO: 914 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluorouridine-3'-phosphorothioate
  modified_base 5: mod_base = OTHER; note = 2`-deoxycytidine-3`-phosphate
  modified_base 7: mod_base = OTHER; note = adenosine-glycol nucleic acid (GNA) S-Isomer
  modified_base 14: mod_base = OTHER; note = 2'-fluorouridine-3'-phosphate
  modified_base 16: mod_base = OTHER; note = 2'-fluoroadenosine-3'-phosphate
  modified_base 21: mod_base = OTHER; note = 2'-O-methylguanosine-3'-phosphorothioate
  modified_base 22: mod_base = OTHER; note = 2'-O-methyluridine-3'- phosphorothioate
  source 1..23: mol_type = other RNA
atttcaaagcactttattgagtt

SEQ ID NO: 915 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxyguanosine-3`-phosphorothioate
  modified_base 5: mod_base = OTHER; note = 2`-deoxyadenosine-3`-phosphate
  modified_base 7: mod_base = OTHER; note = 2`-deoxyadenosine-3`-phosphate
  modified_base 12: mod_base = OTHER; note = 2`-deoxyadenosine -3`-phosphate
  modified_base 14: mod_base = OTHER; note = 2'-fluorouridine-3'-phosphate
  modified_base 21: mod_base = OTHER; note = 2'-O-methylguanosine-3'-phosphorothioate
  modified_base 22: mod_base = OTHER; note = 2'-O-methylcytidine-3'- phosphorothioate
  source 1..23: mol_type = other RNA
agggaaagatgagtccctgagca

SEQ ID NO: 916 - RNA, 23 nt, synthetic construct
  modified_base 2: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxythimidine-3`-phosphorothioate
  modified_base 5: mod_base = OTHER; note = 2`-deoxyadenosine-3`-phosphate
  modified_base 7: mod_base = OTHER; note = 2`-deoxyguanosine-3`-phosphate
  modified_base 12: mod_base = OTHER; note = 2`-deoxyguanosine -3`-phosphate
  modified_base 14: mod_base = OTHER; note = 2'-fluoroguanosine-3'-phosphate
  modified_base 21: mod_base = OTHER; note = 2'-O-methylguanosine-3'-phosphorothioate
  modified_base 22: mod_base = OTHER; note = 2'-O-methylcytidine-3'- phosphorothioate
  source 1..23: mol_type = other RNA
atgaacgtaaggcgacaggagcg

SEQ ID NO: 917 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxycytidine-3`-phosphorothioate
  modified_base 5: mod_base = OTHER; note = 2`-deoxycytidine-3`-phosphate
  modified_base 7: mod_base = OTHER; note = 2`-deoxyguanosine-3`-phosphate
  modified_base 12: mod_base = OTHER; note = 2`-deoxycytidine -3`-phosphate
  modified_base 14: mod_base = OTHER; note = 2'-fluorocytidine-3'-phosphate
  modified_base 21: mod_base = OTHER; note = 2'-O-methylguanosine-3'-phosphorothioate
  modified_base 22: mod_base = OTHER; note = 2'-O-methylcytidine-3'- phosphorothioate
  source 1..23: mol_type = other RNA
actcctgaaggcgcaacagagcc

SEQ ID NO: 918 - RNA, 23 nt, synthetic construct
  modified_base 12: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxyadenosine-3`-phosphorothioate
  modified_base 5: mod_base = OTHER; note = 2`-deoxyguanosine-3`-phosphate
  modified_base 7: mod_base = OTHER; note = 2`-deoxycytidine-3`-phosphate
  modified_base 12: mod_base = OTHER; note = 2`-deoxythimidine -3`-phosphate
  modified_base 14: mod_base = OTHER; note = 2'-fluorocytidine-3'-phosphate
  modified_base 21: mod_base = OTHER; note = 2'-O-methylguanosine-3'-phosphorothioate
  modified_base 22: mod_base = OTHER; note = 2'-O-methylcytidine-3'- phosphorothioate
  source 1..23: mol_type = other RNA
aaacgactgtgtgctcttcagct

SEQ ID NO: 919 - RNA, 23 nt, synthetic construct
  modified_base 7: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 5: mod_base = OTHER; note = 2`-deoxyadenosine -3`-phosphate
  modified_base 7: mod_base = OTHER; note = Thymidine-glycol nucleic acid (GNA) S-Isomer
  modified_base 14: mod_base = OTHER; note = 2'-fluoroguanosine-3'-phosphate
  modified_base 16: mod_base = OTHER; note = 2'-fluoroadenosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'- phosphorothioate
  source 1..23: mol_type = other RNA
aatgagtccctgagcaatcagga

SEQ ID NO: 920 - RNA, 23 nt, synthetic construct
  modified_base 12: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxycytidine-3`-phosphorothioate
  modified_base 5: mod_base = OTHER; note = 2`-deoxycytidine-3`-phosphate
  modified_base 7: mod_base = OTHER; note = 2`-deoxyguanosine-3`-phosphate
  modified_base 12: mod_base = OTHER; note = 2`-deoxythimidine -3`-phosphate
  modified_base 14: mod_base = OTHER; note = 2'-fluorocytidine-3'-phosphate
  modified_base 21: mod_base = OTHER; note = 2'-O-methylguanosine-3'-phosphorothioate
  modified_base 22: mod_base = OTHER; note = 2'-O-methylguanosine-3'- phosphorothioate
  source 1..23: mol_type = other RNA
acagctgatgatgccttgcaggg

SEQ ID NO: 921 - RNA, 23 nt, synthetic construct
  modified_base 5: mod_base = OTHER; note = thymine
  modified_base 7: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluorocytidine-3'-phosphorothioate
  modified_base 5: mod_base = OTHER; note = 2`-deoxythymidine -3`-phosphate
  modified_base 7: mod_base = OTHER; note = Thymidine-glycol nucleic acid (GNA) S-Isomer
  modified_base 14: mod_base = OTHER; note = 2'-fluorouridine-3'-phosphate
  modified_base 16: mod_base = OTHER; note = 2'-fluorocytidine-3'-phosphate
  modified_base 21: mod_base = OTHER; note = 2'-O-methylguanosine-3'-phosphorothioate
  modified_base 22: mod_base = OTHER; note = 2'-O-methyladenosine-3'- phosphorothioate
  source 1..23: mol_type = other RNA
acgttgtccgggttccggcagaa

SEQ ID NO: 922 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluorouridine-3'-phosphorothioate
  modified_base 5: mod_base = OTHER; note = 2`-deoxyguanosine-3`-phosphate
  modified_base 7: mod_base = OTHER; note = adenosine-glycol nucleic acid (GNA) S-Isomer
  modified_base 14: mod_base = OTHER; note = 2'-fluorouridine-3'-phosphate
  modified_base 16: mod_base = OTHER; note = 2'-fluoroguanosine-3'-phosphate
  modified_base 21: mod_base = OTHER; note = 2'-O-methylguanosine-3'-phosphorothioate
  modified_base 22: mod_base = OTHER; note = 2'-O-methylcytidine-3'- phosphorothioate
  source 1..23: mol_type = other RNA
atgggtacatttgtggtacagct

SEQ ID NO: 923 - RNA, 23 nt, synthetic construct
  modified_base 5: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 5: mod_base = OTHER; note = 2`-deoxythimidine -3`-phosphate
  modified_base 7: mod_base = OTHER; note = Adenosine-glycol nucleic acid (GNA) S-Isomer
  modified_base 14: mod_base = OTHER; note = 2'-fluoroguanosine-3'-phosphate
  modified_base 16: mod_base = OTHER; note = 2'-fluorocytidine-3'-phosphate
  modified_base 21: mod_base = OTHER; note = 2'-O-methylguanosine-3'-phosphorothioate
  modified_base 22: mod_base = OTHER; note = 2'-O-methylguanosine-3'- phosphorothioate
  source 1..23: mol_type = other RNA
aggctgaacgtaaggcgacagga

SEQ ID NO: 924 - RNA, 23 nt, synthetic construct
  modified_base 7: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 5: mod_base = OTHER; note = 2`-deoxyguanosine -3`-phosphate
  modified_base 7: mod_base = OTHER; note = Thymidine-glycol nucleic acid (GNA) S-Isomer
  modified_base 14: mod_base = OTHER; note = 2'-fluoroadenosine-3'-phosphate
  modified_base 16: mod_base = OTHER; note = 2'-fluoroadenosine-3'-phosphate
  modified_base 21: mod_base = OTHER; note = 2'-O-methylguanosine-3'-phosphorothioate
  modified_base 22: mod_base = OTHER; note = 2'-O-methyluridine-3'- phosphorothioate
  source 1..23: mol_type = other RNA
aggtgttgtggacagagacagtg

SEQ ID NO: 925 - RNA, 23 nt, synthetic construct
  modified_base 5: mod_base = OTHER; note = thymine
  modified_base 7: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 5: mod_base = OTHER; note = 2`-deoxythimidine -3`-phosphate
  modified_base 7: mod_base = OTHER; note = Thymidine-glycol nucleic acid (GNA) S-Isomer
  modified_base 14: mod_base = OTHER; note = 2'-fluorocytidine-3'-phosphate
  modified_base 16: mod_base = OTHER; note = 2'-fluorocytidine-3'-phosphate
  modified_base 21: mod_base = OTHER; note = 2'-O-methylguanosine-3'-phosphorothioate
  modified_base 22: mod_base = OTHER; note = 2'-O-methylcytidine-3'- phosphorothioate
  source 1..23: mol_type = other RNA
agcttgttgcggtcaccacagcc

SEQ ID NO: 926 - RNA, 23 nt, synthetic construct
  modified_base 12: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxyguanosine-3`-phosphorothioate
  modified_base 5: mod_base = OTHER; note = 2`-deoxycytidine-3`-phosphate
  modified_base 7: mod_base = OTHER; note = 2`-deoxycytidine-3`-phosphate
  modified_base 12: mod_base = OTHER; note = 2`-deoxythimidine -3`-phosphate
  modified_base 14: mod_base = OTHER; note = 2'-fluoroadenosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'- phosphorothioate
  source 1..23: mol_type = other RNA
agcacaccggctgaacgtaaggc

SEQ ID NO: 927 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxyadenosine-3`-phosphorothioate
  modified_base 5: mod_base = OTHER; note = 2`-deoxyguanosine-3`-phosphate
  modified_base 7: mod_base = OTHER; note = 2`-deoxycytidine-3`-phosphate
  modified_base 12: mod_base = OTHER; note = 2`-deoxyguanosine -3`-phosphate
  modified_base 14: mod_base = OTHER; note = 2'-fluorocytidine-3'-phosphate
  modified_base 21: mod_base = OTHER; note = 2'-O-methylguanosine-3'-phosphorothioate
  modified_base 22: mod_base = OTHER; note = 2'-O-methyladenosine-3'- phosphorothioate
  source 1..23: mol_type = other RNA
aaacgacgcgggtcatcgaagac

SEQ ID NO: 928 - RNA, 23 nt, synthetic construct
  modified_base 2: mod_base = OTHER; note = thymine
  modified_base 12: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxythimidine-3`-phosphorothioate
  modified_base 5: mod_base = OTHER; note = 2`-deoxyadenosine-3`-phosphate
  modified_base 7: mod_base = OTHER; note = 2`-deoxyguanosine-3`-phosphate
  modified_base 12: mod_base = OTHER; note = 2`-deoxyguanosine -3`-phosphate
  modified_base 14: mod_base = OTHER; note = 2'-fluoroguanosine-3'-phosphate
  modified_base 21: mod_base = OTHER; note = 2'-O-methylguanosine-3'-phosphorothioate
  modified_base 22: mod_base = OTHER; note = 2'-O-methylcytodine-3'- phosphorothioate
  source 1..23: mol_type = other RNA
atcgaaagtgttgactccaagct

SEQ ID NO: 929 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 5: mod_base = OTHER; note = 2`-deoxyguanosine -3`-phosphate
  modified_base 7: mod_base = OTHER; note = Adenosine-glycol nucleic acid (GNA) S-Isomer
  modified_base 14: mod_base = OTHER; note = 2'-fluoroguanosine-3'-phosphate
  modified_base 16: mod_base = OTHER; note = 2'-fluorouridine-3'-phosphate
  modified_base 21: mod_base = OTHER; note = 2'-O-methylguanosine-3'-phosphorothioate
  modified_base 22: mod_base = OTHER; note = 2'-O-methylcytidine-3'- phosphorothioate
  source 1..23: mol_type = other RNA
aggagaagctgaggctcaaagca

SEQ ID NO: 930 - RNA, 23 nt, synthetic construct
  modified_base 7: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluorouridine-3'-phosphorothioate
  modified_base 5: mod_base = OTHER; note = 2`-deoxyadenosine-3`-phosphate
  modified_base 7: mod_base = OTHER; note = Thymidine-glycol nucleic acid (GNA) S-Isomer
  modified_base 14: mod_base = OTHER; note = 2'-fluorouridine-3'-phosphate
  modified_base 16: mod_base = OTHER; note = 2'-fluoroadenosine-3'-phosphate
  modified_base 21: mod_base = OTHER; note = 2'-O-methylcytidine-3'-phosphorothioate
  modified_base 22: mod_base = OTHER; note = 2'-O-methyluridine-3'- phosphorothioate
  source 1..23: mol_type = other RNA
atgcagtggtctttcactttctt

SEQ ID NO: 931 - RNA, 23 nt, synthetic construct
  modified_base 5: mod_base = OTHER; note = thymine
  modified_base 7: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 5: mod_base = OTHER; note = 2`-deoxythimidine -3`-phosphate
  modified_base 7: mod_base = OTHER; note = Thymidine-glycol nucleic acid (GNA) S-Isomer
  modified_base 14: mod_base = OTHER; note = 2'-fluorocytidine-3'-phosphate
  modified_base 16: mod_base = OTHER; note = 2'-fluoroguanosine-3'-phosphate
  modified_base 21: mod_base = OTHER; note = 2'-O-methylcytidine-3'-phosphorothioate
  modified_base 22: mod_base = OTHER; note = 2'-O-methylcytidine-3'- phosphorothioate
  source 1..23: mol_type = other RNA
aggatgtcgttgtccgggttccg

SEQ ID NO: 932 - RNA, 23 nt, synthetic construct
  modified_base 12: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxycytidine-3`-phosphorothioate
  modified_base 5: mod_base = OTHER; note = 2`-deoxyadenosine-3`-phosphate
  modified_base 7: mod_base = OTHER; note = 2`-deoxycytidine-3`-phosphate
  modified_base 12: mod_base = OTHER; note = 2`-deoxythimidine -3`-phosphate
  modified_base 14: mod_base = OTHER; note = 2'-fluorouridine-3'-phosphate
  modified_base 21: mod_base = OTHER; note = 2'-O-methylcytidine-3'-phosphorothioate
  modified_base 22: mod_base = OTHER; note = 2'-O-methylcytidine-3'- phosphorothioate
  source 1..23: mol_type = other RNA
acaaagcactttattgagttcct

SEQ ID NO: 933 - RNA, 23 nt, synthetic construct
  modified_base 12: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxyadenosine-3`-phosphorothioate
  modified_base 5: mod_base = OTHER; note = 2`-deoxyadenosine-3`-phosphate
  modified_base 7: mod_base = OTHER; note = 2`-deoxyguanosine-3`-phosphate
  modified_base 12: mod_base = OTHER; note = 2`-deoxythimidine -3`-phosphate
  modified_base 14: mod_base = OTHER; note = 2'-fluorouridine-3'-phosphate
  modified_base 21: mod_base = OTHER; note = 2'-O-methylcytidine-3'-phosphorothioate
  modified_base 22: mod_base = OTHER; note = 2'-O-methyladenosine-3'- phosphorothioate
  source 1..23: mol_type = other RNA
aagaacgactgtgtgctcttcag

SEQ ID NO: 934 - RNA, 23 nt, synthetic construct
  modified_base 7: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 5: mod_base = OTHER; note = 2`-deoxycytidine -3`-phosphate
  modified_base 7: mod_base = OTHER; note = Thymidine-glycol nucleic acid (GNA) S-Isomer
  modified_base 14: mod_base = OTHER; note = 2'-fluorouridine-3'-phosphate
  modified_base 16: mod_base = OTHER; note = 2'-fluoroguanosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'- phosphorothioate
  source 1..23: mol_type = other RNA
aacgcctggcttgttgcggtcac

SEQ ID NO: 935 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxyguanosine-3`-phosphorothioate
  modified_base 5: mod_base = OTHER; note = 2`-deoxyadenosine-3`-phosphate
  modified_base 7: mod_base = OTHER; note = 2`-deoxyadenosine-3`-phosphate
  modified_base 12: mod_base = OTHER; note = 2`-deoxycytidine -3`-phosphate
  modified_base 14: mod_base = OTHER; note = 2'-fluoroguanosine-3'-phosphate
  modified_base 21: mod_base = OTHER; note = 2'-O-methylcytidine-3'-phosphorothioate
  modified_base 22: mod_base = OTHER; note = 2'-O-methyluridine-3'- phosphorothioate
  source 1..23: mol_type = other RNA
agtgagaacgactgtgtgctctt

SEQ ID NO: 936 - RNA, 23 nt, synthetic construct
  modified_base 7: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluorouridine-3'-phosphorothioate
  modified_base 5: mod_base = OTHER; note = 2`-deoxyguanosine-3`-phosphate
  modified_base 7: mod_base = OTHER; note = Thymidine-glycol nucleic acid (GNA) S-Isomer
  modified_base 14: mod_base = OTHER; note = 2'-fluorouridine-3'-phosphate
  modified_base 16: mod_base = OTHER; note = 2'-fluoroadenosine-3'-phosphate
  modified_base 21: mod_base = OTHER; note = 2'-O-methylcytidine-3'-phosphorothioate
  modified_base 22: mod_base = OTHER; note = 2'-O-methylcytidine-3'- phosphorothioate
  source 1..23: mol_type = other RNA
atcagctttgtacttatgctcct

SEQ ID NO: 937 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxyadenosine-3`-phosphorothioate
  modified_base 5: mod_base = OTHER; note = 2`-deoxycytidine-3`-phosphate
  modified_base 7: mod_base = OTHER; note = 2`-deoxyguanosine-3`-phosphate
  modified_base 12: mod_base = OTHER; note = 2`-deoxyguanosine -3`-phosphate
  modified_base 14: mod_base = OTHER; note = 2'-fluorouridine-3'-phosphate
  modified_base 21: mod_base = OTHER; note = 2'-O-methylcytidine-3'-phosphorothioate
  modified_base 22: mod_base = OTHER; note = 2'-O-methyladenosine-3'- phosphorothioate
  source 1..23: mol_type = other RNA
aaaccggagaagctgaggctcaa

SEQ ID NO: 938 - RNA, 23 nt, synthetic construct
  modified_base 5: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 5: mod_base = OTHER; note = 2`-deoxythimidine -3`-phosphate
  modified_base 7: mod_base = OTHER; note = Adenosine-glycol nucleic acid (GNA) S-Isomer
  modified_base 14: mod_base = OTHER; note = 2'-fluoroadenosine-3'-phosphate
  modified_base 16: mod_base = OTHER; note = 2'-fluoroadenosine-3'-phosphate
  modified_base 21: mod_base = OTHER; note = 2'-O-methylcytidine-3'-phosphorothioate
  modified_base 22: mod_base = OTHER; note = 2'-O-methyluridine-3'- phosphorothioate
  source 1..23: mol_type = other RNA
agggtcatcgaagacagactctt

SEQ ID NO: 939 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxyadenosine-3`-phosphorothioate
  modified_base 5: mod_base = OTHER; note = 2`-deoxyadenosine-3`-phosphate
  modified_base 7: mod_base = OTHER; note = 2`-deoxycytidine-3`-phosphate
  modified_base 12: mod_base = OTHER; note = 2`-deoxycytidine -3`-phosphate
  modified_base 14: mod_base = OTHER; note = 2'-fluorocytidine-3'-phosphate
  modified_base 21: mod_base = OTHER; note = 2'-O-methylcytidine-3'-phosphorothioate
  modified_base 22: mod_base = OTHER; note = 2'-O-methyluridine-3'- phosphorothioate
  source 1..23: mol_type = other RNA
aaggacccttgcactggcatctg

SEQ ID NO: 940 - RNA, 23 nt, synthetic construct
  modified_base 5: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluorouridine-3'-phosphorothioate
  modified_base 5: mod_base = OTHER; note = 2`-deoxythymidine-3`-phosphate
  modified_base 7: mod_base = OTHER; note = adenosine-glycol nucleic acid (GNA) S-Isomer
  modified_base 14: mod_base = OTHER; note = 2'-fluoroguanosine-3'-phosphate
  modified_base 16: mod_base = OTHER; note = 2'-fluoroguanosine-3'-phosphate
  modified_base 21: mod_base = OTHER; note = 2'-O-methylcytidine-3'-phosphorothioate
  modified_base 22: mod_base = OTHER; note = 2'-O-methylcytidine-3'- phosphorothioate
  source 1..23: mol_type = other RNA
atattgagttcctgcgccatcct

SEQ ID NO: 941 - RNA, 23 nt, synthetic construct
  modified_base 5: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 5: mod_base = OTHER; note = 2`-deoxythymidine -3`-phosphate
  modified_base 7: mod_base = OTHER; note = Adenosine-glycol nucleic acid (GNA) S-Isomer
  modified_base 14: mod_base = OTHER; note = 2'-fluoroguanosine-3'-phosphate
  modified_base 16: mod_base = OTHER; note = 2'-fluoroguanosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'- phosphorothioate
  source 1..23: mol_type = other RNA
aagatgagtccctgagcaatcag

SEQ ID NO: 942 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxycytidine-3`-phosphorothioate
  modified_base 5: mod_base = OTHER; note = 2`-deoxycytidine-3`-phosphate
  modified_base 7: mod_base = OTHER; note = 2`-deoxyadenosine-3`-phosphate
  modified_base 12: mod_base = OTHER; note = 2`-deoxyadenosine -3`-phosphate
  modified_base 14: mod_base = OTHER; note = 2'-fluoroadenosine-3'-phosphate
  modified_base 21: mod_base = OTHER; note = 2'-O-methylcytidine-3'-phosphorothioate
  modified_base 22: mod_base = OTHER; note = 2'-O-methylguanosine-3'- phosphorothioate
  source 1..23: mol_type = other RNA
acatcgaagacagactcttgcgg

SEQ ID NO: 943 - RNA, 23 nt, synthetic construct
  modified_base 5: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluorocytidine-3'-phosphorothioate
  modified_base 5: mod_base = OTHER; note = 2`-deoxythymidine -3`-phosphate
  modified_base 7: mod_base = OTHER; note = Adenosine-glycol nucleic acid (GNA) S-Isomer
  modified_base 14: mod_base = OTHER; note = 2'-fluorocytidine-3'-phosphate
  modified_base 16: mod_base = OTHER; note = 2'-fluoroguanosine-3'-phosphate
  modified_base 21: mod_base = OTHER; note = 2'-O-methylcytidine-3'-phosphorothioate
  modified_base 22: mod_base = OTHER; note = 2'-O-methyluridine-3'- phosphorothioate
  source 1..23: mol_type = other RNA
acagtgagaacgactgtgtgctc

SEQ ID NO: 944 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxyguanosine-3`-phosphorothioate
  modified_base 5: mod_base = OTHER; note = 2`-deoxyadenosine-3`-phosphate
  modified_base 7: mod_base = OTHER; note = 2`-deoxyadenosine-3`-phosphate
  modified_base 12: mod_base = OTHER; note = 2`-deoxycytidine -3`-phosphate
  modified_base 14: mod_base = OTHER; note = 2'-fluoroguanosine-3'-phosphate
  modified_base 21: mod_base = OTHER; note = 2'-O-methylcytidine-3'-phosphorothioate
  modified_base 22: mod_base = OTHER; note = 2'-O-methyluridine-3'- phosphorothioate
  source 1..23: mol_type = other RNA
agcaacagagccaggtcgtgctg

SEQ ID NO: 945 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 5: mod_base = OTHER; note = 2`-deoxyadenosine -3`-phosphate
  modified_base 7: mod_base = OTHER; note = Adenosine-glycol nucleic acid (GNA) S-Isomer
  modified_base 14: mod_base = OTHER; note = 2'-fluoroguanosine-3'-phosphate
  modified_base 16: mod_base = OTHER; note = 2'-fluorouridine-3'-phosphate
  modified_base 21: mod_base = OTHER; note = 2'-O-methylcytidine-3'-phosphorothioate
  modified_base 22: mod_base = OTHER; note = 2'-O-methyluridine-3'- phosphorothioate
  source 1..23: mol_type = other RNA
agcaacagagccaggtcgtgctg

SEQ ID NO: 946 - RNA, 23 nt, synthetic construct
  modified_base 7: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluorouridine-3'-phosphorothioate
  modified_base 5: mod_base = OTHER; note = 2`-deoxycytidine-3`-phosphate
  modified_base 7: mod_base = OTHER; note = Thymidine-glycol nucleic acid (GNA) S-Isomer
  modified_base 14: mod_base = OTHER; note = 2'-fluoroadenosine-3'-phosphate
  modified_base 16: mod_base = OTHER; note = 2'-fluoroadenosine-3'-phosphate
  modified_base 21: mod_base = OTHER; note = 2'-O-methylcytidine-3'-phosphorothioate
  modified_base 22: mod_base = OTHER; note = 2'-O-methyluridine-3'- phosphorothioate
  source 1..23: mol_type = other RNA
atggcatctggccacagctgctt

SEQ ID NO: 947 - RNA, 23 nt, synthetic construct
  modified_base 7: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxyguanosine-3`-phosphorothioate
  modified_base 5: mod_base = OTHER; note = 2`-deoxycytidine-3`-phosphate
  modified_base 7: mod_base = OTHER; note = 2`-deoxythimidine-3`-phosphate
  modified_base 12: mod_base = OTHER; note = 2`-deoxyguanosine -3`-phosphate
  modified_base 14: mod_base = OTHER; note = 2'-fluoroguanosine-3'-phosphate
  modified_base 21: mod_base = OTHER; note = 2'-O-methylcytidine-3'-phosphorothioate
  modified_base 22: mod_base = OTHER; note = 2'-O-methylguanosine-3'- phosphorothioate
  source 1..23: mol_type = other RNA
agcactttattgagttcctgcgc

SEQ ID NO: 948 - RNA, 23 nt, synthetic construct
  modified_base 5: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxycytidine-3`-phosphorothioate
  modified_base 5: mod_base = OTHER; note = 2`-deoxythimidine-3`-phosphate
  modified_base 7: mod_base = OTHER; note = 2`-deoxyguanosine-3`-phosphate
  modified_base 12: mod_base = OTHER; note = 2`-deoxyguanosine -3`-phosphate
  modified_base 14: mod_base = OTHER; note = 2'-fluorocytidine-3'-phosphate
  modified_base 21: mod_base = OTHER; note = 2'-O-methylcytidine-3'-phosphorothioate
  modified_base 22: mod_base = OTHER; note = 2'-O-methylcytidine-3'- phosphorothioate
  source 1..23: mol_type = other RNA
acccttgcactggcatctggcca

SEQ ID NO: 949 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxycytidine-3`-phosphorothioate
  modified_base 5: mod_base = OTHER; note = 2`-deoxycytidine-3`-phosphate
  modified_base 7: mod_base = OTHER; note = 2`-deoxyguanosine-3`-phosphate
  modified_base 12: mod_base = OTHER; note = 2`-deoxyguanosine -3`-phosphate
  modified_base 14: mod_base = OTHER; note = 2'-fluorocytidine-3'-phosphate
  modified_base 21: mod_base = OTHER; note = 2'-O-methylcytidine-3'-phosphorothioate
  modified_base 22: mod_base = OTHER; note = 2'-O-methyluridine-3'- phosphorothioate
  source 1..23: mol_type = other RNA
acatcggtgtagacgcctggctt

SEQ ID NO: 950 - RNA, 23 nt, synthetic construct
  modified_base 7: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 5: mod_base = OTHER; note = 2`-deoxycytidine -3`-phosphate
  modified_base 7: mod_base = OTHER; note = Thymidine-glycol nucleic acid (GNA) S-Isomer
  modified_base 14: mod_base = OTHER; note = 2'-fluorouridine-3'-phosphate
  modified_base 16: mod_base = OTHER; note = 2'-fluorouridine-3'-phosphate
  modified_base 21: mod_base = OTHER; note = 2'-O-methylcytidine-3'-phosphorothioate
  modified_base 22: mod_base = OTHER; note = 2'-O-methyluridine-3'- phosphorothioate
  source 1..23: mol_type = other RNA
aggtctttcactttcttgggctc

SEQ ID NO: 951 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxyadenosine-3`-phosphorothioate
  modified_base 5: mod_base = OTHER; note = 2`-deoxycytidine-3`-phosphate
  modified_base 7: mod_base = OTHER; note = 2`-deoxyguanosine-3`-phosphate
  modified_base 12: mod_base = OTHER; note = 2`-deoxyadenosine -3`-phosphate
  modified_base 14: mod_base = OTHER; note = 2'-fluorocytidine-3'-phosphate
  modified_base 21: mod_base = OTHER; note = 2'-O-methylcytidine-3'-phosphorothioate
  modified_base 22: mod_base = OTHER; note = 2'-O-methylguanosine-3'- phosphorothioate
  source 1..23: mol_type = other RNA
aacaccggctgaacgtaaggcga

SEQ ID NO: 952 - RNA, 23 nt, synthetic construct
  modified_base 5: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxyadenosine-3`-phosphorothioate
  modified_base 5: mod_base = OTHER; note = 2`-deoxythimidine-3`-phosphate
  modified_base 7: mod_base = OTHER; note = 2`-deoxyadenosine-3`-phosphate
  modified_base 12: mod_base = OTHER; note = 2`-deoxyguanosine -3`-phosphate
  modified_base 14: mod_base = OTHER; note = 2'-fluorouridine-3'-phosphate
  modified_base 21: mod_base = OTHER; note = 2'-O-methylcytidine-3'-phosphorothioate
  modified_base 22: mod_base = OTHER; note = 2'-O-methylcytidine-3'- phosphorothioate
  source 1..23: mol_type = other RNA
aactttattgagttcctgcgcca

SEQ ID NO: 953 - RNA, 23 nt, synthetic construct
  modified_base 7: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxycytidine-3`-phosphorothioate
  modified_base 5: mod_base = OTHER; note = 2`-deoxycytidine-3`-phosphate
  modified_base 7: mod_base = OTHER; note = 2`-deoxythimidine-3`-phosphate
  modified_base 12: mod_base = OTHER; note = 2`-deoxycytidine -3`-phosphate
  modified_base 14: mod_base = OTHER; note = 2'-fluoroguanosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'- phosphorothioate
  source 1..23: mol_type = other RNA
accgcatcctcctgaaggcgcaa

SEQ ID NO: 954 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxyadenosine-3`-phosphorothioate
  modified_base 5: mod_base = OTHER; note = 2`-deoxyguanosine-3`-phosphate
  modified_base 7: mod_base = OTHER; note = 2`-deoxycytidine-3`-phosphate
  modified_base 12: mod_base = OTHER; note = 2`-deoxyguanosine -3`-phosphate
  modified_base 14: mod_base = OTHER; note = 2'-fluoroguanosine-3'-phosphate
  modified_base 21: mod_base = OTHER; note = 2'-O-methylcytidine-3'-phosphorothioate
  modified_base 22: mod_base = OTHER; note = 2'-O-methyluridine-3'- phosphorothioate
  source 1..23: mol_type = other RNA
aacagactcttgcggagccgctg

SEQ ID NO: 955 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxyguanosine-3`-phosphorothioate
  modified_base 5: mod_base = OTHER; note = 2`-deoxyadenosine-3`-phosphate
  modified_base 7: mod_base = OTHER; note = 2`-deoxyguanosine-3`-phosphate
  modified_base 12: mod_base = OTHER; note = 2`-deoxyguanosine -3`-phosphate
  modified_base 14: mod_base = OTHER; note = 2'-fluorocytidine-3'-phosphate
  modified_base 21: mod_base = OTHER; note = 2'-O-methylcytidine-3'-phosphorothioate
  modified_base 22: mod_base = OTHER; note = 2'-O-methyladenosine-3'- phosphorothioate
  source 1..23: mol_type = other RNA
aggaaagatgagtccctgagcaa

SEQ ID NO: 956 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 5: mod_base = OTHER; note = 2`-deoxyadenosine -3`-phosphate
  modified_base 7: mod_base = OTHER; note = Adenosine-glycol nucleic acid (GNA) S-Isomer
  modified_base 14: mod_base = OTHER; note = 2'-fluorouridine-3'-phosphate
  modified_base 16: mod_base = OTHER; note = 2'-fluorocytidine-3'-phosphate
  modified_base 21: mod_base = OTHER; note = 2'-O-methylcytidine-3'-phosphorothioate
  modified_base 22: mod_base = OTHER; note = 2'-O-methylcytidine-3'- phosphorothioate
  source 1..23: mol_type = other RNA
aaagacagactcttgcggagccg

SEQ ID NO: 957 - RNA, 23 nt, synthetic construct
  modified_base 7: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxyguanosine-3`-phosphorothioate
  modified_base 5: mod_base = OTHER; note = 2`-deoxycytidine-3`-phosphate
  modified_base 7: mod_base = OTHER; note = 2`-deoxythimidine-3`-phosphate
  modified_base 12: mod_base = OTHER; note = 2`-deoxycytidine -3`-phosphate
  modified_base 14: mod_base = OTHER; note = 2'-fluoroadenosine-3'-phosphate
  modified_base 21: mod_base = OTHER; note = 2'-O-methylcytidine-3'-phosphorothioate
  modified_base 22: mod_base = OTHER; note = 2'-O-methylguanosine-3'- phosphorothioate
  source 1..23: mol_type = other RNA
agaacgtaaggcgacaggagcgc

SEQ ID NO: 958 - RNA, 23 nt, synthetic construct
  modified_base 12: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxycytidine-3`-phosphorothioate
  modified_base 5: mod_base = OTHER; note = 2`-deoxyguanosine-3`-phosphate
  modified_base 7: mod_base = OTHER; note = 2`-deoxyadenosine-3`-phosphate
  modified_base 12: mod_base = OTHER; note = 2`-deoxythimidine -3`-phosphate
  modified_base 14: mod_base = OTHER; note = 2'-fluorocytidine-3'-phosphate
  modified_base 21: mod_base = OTHER; note = 2'-O-methylcytidine-3'-phosphorothioate
  modified_base 22: mod_base = OTHER; note = 2'-O-methyladenosine-3'- phosphorothioate
  source 1..23: mol_type = other RNA
acgaggaaccctgcgcagagcat

SEQ ID NO: 959 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluorocytidine-3'-phosphorothioate
  modified_base 5: mod_base = OTHER; note = 2`-deoxyguanosine -3`-phosphate
  modified_base 7: mod_base = OTHER; note = Adenosine-glycol nucleic acid (GNA) S-Isomer
  modified_base 14: mod_base = OTHER; note = 2'-fluorocytidine-3'-phosphate
  modified_base 16: mod_base = OTHER; note = 2'-fluorocytidine-3'-phosphate
  modified_base 21: mod_base = OTHER; note = 2'-O-methylcytidine-3'-phosphorothioate
  modified_base 22: mod_base = OTHER; note = 2'-O-methyladenosine-3'- phosphorothioate
  source 1..23: mol_type = other RNA
acgaggaaccctgcgcagagcat

SEQ ID NO: 960 - RNA, 23 nt, synthetic construct
  modified_base 2: mod_base = OTHER; note = thymine
  modified_base 5: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxythimidine-3`-phosphorothioate
  modified_base 5: mod_base = OTHER; note = 2`-deoxythimidine-3`-phosphate
  modified_base 7: mod_base = OTHER; note = 2`-deoxyadenosine-3`-phosphate
  modified_base 12: mod_base = OTHER; note = 2`-deoxyguanosine -3`-phosphate
  modified_base 14: mod_base = OTHER; note = 2'-fluoroadenosine-3'-phosphate
  modified_base 21: mod_base = OTHER; note = 2'-O-methylcytidine-3'-phosphorothioate
  modified_base 22: mod_base = OTHER; note = 2'-O-methylcytidine-3'- phosphorothioate
  source 1..23: mol_type = other RNA
atcctgaaggcgcaacagagcca

SEQ ID NO: 961 - RNA, 23 nt, synthetic construct
  modified_base 5: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluorouridine-3'-phosphorothioate
  modified_base 5: mod_base = OTHER; note = 2`-deoxythymidine-3`-phosphate
  modified_base 7: mod_base = OTHER; note = adenosine-glycol nucleic acid (GNA) S-Isomer
  modified_base 14: mod_base = OTHER; note = 2'-fluoroadenosine-3'-phosphate
  modified_base 16: mod_base = OTHER; note = 2'-fluorocytidine-3'-phosphate
  modified_base 21: mod_base = OTHER; note = 2'-O-methylcytidine-3'-phosphorothioate
  modified_base 22: mod_base = OTHER; note = 2'-O-methylcytidine-3'- phosphorothioate
  source 1..23: mol_type = other RNA
atcctgaaggcgcaacagagcca

SEQ ID NO: 962 - RNA, 23 nt, synthetic construct
  modified_base 7: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxyadenosine-3`-phosphorothioate
  modified_base 5: mod_base = OTHER; note = 2`-deoxyadenosine-3`-phosphate
  modified_base 7: mod_base = OTHER; note = 2`-deoxythimidine-3`-phosphate
  modified_base 12: mod_base = OTHER; note = 2`-deoxyguanosine -3`-phosphate
  modified_base 14: mod_base = OTHER; note = 2'-fluorouridine-3'-phosphate
  modified_base 21: mod_base = OTHER; note = 2'-O-methylcytidine-3'-phosphorothioate
  modified_base 22: mod_base = OTHER; note = 2'-O-methyluridine-3'- phosphorothioate
  source 1..23: mol_type = other RNA
aacgactgtgtgctcttcagctt

SEQ ID NO: 963 - RNA, 23 nt, synthetic construct
  modified_base 12: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxycytidine-3`-phosphorothioate
  modified_base 5: mod_base = OTHER; note = 2`-deoxyguanosine-3`-phosphate
  modified_base 7: mod_base = OTHER; note = 2`-deoxyguanosine-3`-phosphate
  modified_base 12: mod_base = OTHER; note = 2`-deoxythimidine -3`-phosphate
  modified_base 14: mod_base = OTHER; note = 2'-fluoroadenosine-3'-phosphate
  modified_base 21: mod_base = OTHER; note = 2'-O-methylcytidine-3'-phosphorothioate
  modified_base 22: mod_base = OTHER; note = 2'-O-methyluridine-3'- phosphorothioate
  source 1..23: mol_type = other RNA
acccgcggccatcatagcagctt

SEQ ID NO: 964 - RNA, 23 nt, synthetic construct
  modified_base 7: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluorocytidine-3'-phosphorothioate
  modified_base 5: mod_base = OTHER; note = 2`-deoxyguanosine -3`-phosphate
  modified_base 7: mod_base = OTHER; note = Thymidine-glycol nucleic acid (GNA) S-Isomer
  modified_base 14: mod_base = OTHER; note = 2'-fluoroadenosine-3'-phosphate
  modified_base 16: mod_base = OTHER; note = 2'-fluoroadenosine-3'-phosphate
  modified_base 21: mod_base = OTHER; note = 2'-O-methylcytidine-3'-phosphorothioate
  modified_base 22: mod_base = OTHER; note = 2'-O-methylguanosine-3'- phosphorothioate
  source 1..23: mol_type = other RNA
acttggtcctcacacaccagcgg

SEQ ID NO: 965 - RNA, 23 nt, synthetic construct
  modified_base 7: mod_base = OTHER; note = thymine
  modified_base 12: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxycytidine-3`-phosphorothioate
  modified_base 5: mod_base = OTHER; note = 2`-deoxyguanosine-3`-phosphate
  modified_base 7: mod_base = OTHER; note = 2`-deoxythimidine-3`-phosphate
  modified_base 12: mod_base = OTHER; note = 2`-deoxythimidine -3`-phosphate
  modified_base 14: mod_base = OTHER; note = 2'-fluoroadenosine-3'-phosphate
  modified_base 21: mod_base = OTHER; note = 2'-O-methylcytidine-3'-phosphorothioate
  modified_base 22: mod_base = OTHER; note = 2'-O-methylcytidine-3'- phosphorothioate
  source 1..23: mol_type = other RNA
acttgttgcggtcaccacagccc

SEQ ID NO: 966 - RNA, 23 nt, synthetic construct
  modified_base 7: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluorocytidine-3'-phosphorothioate
  modified_base 5: mod_base = OTHER; note = 2`-deoxyguanosine -3`-phosphate
  modified_base 7: mod_base = OTHER; note = Thymidine-glycol nucleic acid (GNA) S-Isomer
  modified_base 14: mod_base = OTHER; note = 2'-fluoroadenosine-3'-phosphate
  modified_base 16: mod_base = OTHER; note = 2'-fluorocytidine-3'-phosphate
  modified_base 21: mod_base = OTHER; note = 2'-O-methylcytidine-3'-phosphorothioate
  modified_base 22: mod_base = OTHER; note = 2'-O-methylcytidine-3'- phosphorothioate
  source 1..23: mol_type = other RNA
acttgttgcggtcaccacagccc

SEQ ID NO: 967 - RNA, 23 nt, synthetic construct
  modified_base 5: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 5: mod_base = OTHER; note = 2`-deoxythimidine -3`-phosphate
  modified_base 7: mod_base = OTHER; note = Adenosine-glycol nucleic acid (GNA) S-Isomer
  modified_base 14: mod_base = OTHER; note = 2'-fluorocytidine-3'-phosphate
  modified_base 16: mod_base = OTHER; note = 2'-fluorouridine-3'-phosphate
  modified_base 21: mod_base = OTHER; note = 2'-O-methylcytidine-3'-phosphorothioate
  modified_base 22: mod_base = OTHER; note = 2'-O-methylcytidine-3'- phosphorothioate
  source 1..23: mol_type = other RNA
agcatgagtgggacatgaagcct

SEQ ID NO: 968 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxyguanosine-3`-phosphorothioate
  modified_base 5: mod_base = OTHER; note = 2`-deoxyadenosine-3`-phosphate
  modified_base 7: mod_base = OTHER; note = 2`-deoxyguanosine-3`-phosphate
  modified_base 12: mod_base = OTHER; note = 2`-deoxyguanosine -3`-phosphate
  modified_base 14: mod_base = OTHER; note = 2'-fluorocytidine-3'-phosphate
  modified_base 21: mod_base = OTHER; note = 2'-O-methylcytidine-3'-phosphorothioate
  modified_base 22: mod_base = OTHER; note = 2'-O-methyladenosine-3'- phosphorothioate
  source 1..23: mol_type = other RNA
agagaagctgaggctcaaagcac

SEQ ID NO: 969 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 5: mod_base = OTHER; note = 2`-deoxyguanosine -3`-phosphate
  modified_base 7: mod_base = OTHER; note = Adenosine-glycol nucleic acid (GNA) S-Isomer
  modified_base 14: mod_base = OTHER; note = 2'-fluorouridine-3'-phosphate
  modified_base 16: mod_base = OTHER; note = 2'-fluoroadenosine-3'-phosphate
  modified_base 21: mod_base = OTHER; note = 2'-O-methylcytidine-3'-phosphorothioate
  modified_base 22: mod_base = OTHER; note = 2'-O-methyluridine-3'- phosphorothioate
  source 1..23: mol_type = other RNA
aaaagcactttattgagttcctg

SEQ ID NO: 970 - RNA, 23 nt, synthetic construct
  modified_base 7: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxycytidine-3`-phosphorothioate
  modified_base 5: mod_base = OTHER; note = 2`-deoxycytidine-3`-phosphate
  modified_base 7: mod_base = OTHER; note = 2`-deoxythimidine-3`-phosphate
  modified_base 12: mod_base = OTHER; note = 2`-deoxycytidine -3`-phosphate
  modified_base 14: mod_base = OTHER; note = 2'-fluorouridine-3'-phosphate
  modified_base 21: mod_base = OTHER; note = 2'-O-methylcytidine-3'-phosphorothioate
  modified_base 22: mod_base = OTHER; note = 2'-O-methyluridine-3'- phosphorothioate
  source 1..23: mol_type = other RNA
acagctttgtacttatgctcctt

SEQ ID NO: 971 - RNA, 23 nt, synthetic construct
  modified_base 5: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluorocytidine-3'-phosphorothioate
  modified_base 5: mod_base = OTHER; note = 2`-deoxythymidine -3`-phosphate
  modified_base 7: mod_base = OTHER; note = Adenosine-glycol nucleic acid (GNA) S-Isomer
  modified_base 14: mod_base = OTHER; note = 2'-fluorouridine-3'-phosphate
  modified_base 16: mod_base = OTHER; note = 2'-fluoroguanosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'- phosphorothioate
  source 1..23: mol_type = other RNA
actttcactttcttgggctccaa

SEQ ID NO: 972 - RNA, 23 nt, synthetic construct
  modified_base 5: mod_base = OTHER; note = thymine
  modified_base 12: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxyguanosine-3`-phosphorothioate
  modified_base 5: mod_base = OTHER; note = 2`-deoxythimidine-3`-phosphate
  modified_base 7: mod_base = OTHER; note = 2`-deoxyguanosine-3`-phosphate
  modified_base 12: mod_base = OTHER; note = 2`-deoxythimidine -3`-phosphate
  modified_base 14: mod_base = OTHER; note = 2'-fluorouridine-3'-phosphate
  modified_base 21: mod_base = OTHER; note = 2'-O-methylcytidine-3'-phosphorothioate
  modified_base 22: mod_base = OTHER; note = 2'-O-methyladenosine-3'- phosphorothioate
  source 1..23: mol_type = other RNA
agaatcgaaagtgttgactccaa

SEQ ID NO: 973 - RNA, 23 nt, synthetic construct
  modified_base 12: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxyguanosine-3`-phosphorothioate
  modified_base 5: mod_base = OTHER; note = 2`-deoxyadenosine-3`-phosphate
  modified_base 7: mod_base = OTHER; note = 2`-deoxyadenosine-3`-phosphate
  modified_base 12: mod_base = OTHER; note = 2`-deoxythimidine -3`-phosphate
  modified_base 14: mod_base = OTHER; note = 2'-fluorouridine-3'-phosphate
  modified_base 21: mod_base = OTHER; note = 2'-O-methylcytidine-3'-phosphorothioate
  modified_base 22: mod_base = OTHER; note = 2'-O-methyluridine-3'- phosphorothioate
  source 1..23: mol_type = other RNA
agccacatcggtgtagacgcctg

SEQ ID NO: 974 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 5: mod_base = OTHER; note = 2`-deoxyadenosine -3`-phosphate
  modified_base 7: mod_base = OTHER; note = Adenosine-glycol nucleic acid (GNA) S-Isomer
  modified_base 14: mod_base = OTHER; note = 2'-fluorouridine-3'-phosphate
  modified_base 16: mod_base = OTHER; note = 2'-fluoroguanosine-3'-phosphate
  modified_base 21: mod_base = OTHER; note = 2'-O-methylcytidine-3'-phosphorothioate
  modified_base 22: mod_base = OTHER; note = 2'-O-methyluridine-3'- phosphorothioate
  source 1..23: mol_type = other RNA
agccacatcggtgtagacgcctg

SEQ ID NO: 975 - RNA, 23 nt, synthetic construct
  modified_base 12: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxyadenosine-3`-phosphorothioate
  modified_base 5: mod_base = OTHER; note = 2`-deoxycytidine-3`-phosphate
  modified_base 7: mod_base = OTHER; note = 2`-deoxyguanosine-3`-phosphate
  modified_base 12: mod_base = OTHER; note = 2`-deoxythimidine -3`-phosphate
  modified_base 14: mod_base = OTHER; note = 2'-fluoroguanosine-3'-phosphate
  modified_base 21: mod_base = OTHER; note = 2'-O-methylcytidine-3'-phosphorothioate
  modified_base 22: mod_base = OTHER; note = 2'-O-methylguanosine-3'- phosphorothioate
  source 1..23: mol_type = other RNA
aagacagactcttgcggagccgc

SEQ ID NO: 976 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxycytidine-3`-phosphorothioate
  modified_base 5: mod_base = OTHER; note = 2`-deoxyguanosine-3`-phosphate
  modified_base 7: mod_base = OTHER; note = 2`-deoxyadenosine-3`-phosphate
  modified_base 12: mod_base = OTHER; note = 2`-deoxycytidine-3`-phosphate
  modified_base 14: mod_base = OTHER; note = 2'-fluoroadenosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'- phosphorothioate
  source 1..23: mol_type = other RNA
acctgaaggcgcaacagagccag

SEQ ID NO: 977 - RNA, 23 nt, synthetic construct
  modified_base 7: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 5: mod_base = OTHER; note = 2`-deoxyadenosine-3`-phosphate
  modified_base 7: mod_base = OTHER; note = Thymidine-glycol nucleic acid (GNA) S-Isomer
  modified_base 14: mod_base = OTHER; note = 2'-fluorocytidine-3'-phosphate
  modified_base 16: mod_base = OTHER; note = 2'-fluoroguanosine-3'-phosphate
  modified_base 21: mod_base = OTHER; note = 2'-O-methylcytidine-3'-phosphorothioate
  modified_base 22: mod_base = OTHER; note = 2'-O-methyluridine-3'- phosphorothioate
  source 1..23: mol_type = other RNA
aggcagtgggcatcaggaccctt

SEQ ID NO: 978 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxyguanosine-3`-phosphorothioate
  modified_base 5: mod_base = OTHER; note = 2`-deoxyguanosine-3`-phosphate
  modified_base 7: mod_base = OTHER; note = 2`-deoxyadenosine-3`-phosphate
  modified_base 12: mod_base = OTHER; note = 2`-deoxyadenosine -3`-phosphate
  modified_base 14: mod_base = OTHER; note = 2'-fluoroguanosine-3'-phosphate
  modified_base 21: mod_base = OTHER; note = 2'-O-methylcytidine-3'-phosphorothioate
  modified_base 22: mod_base = OTHER; note = 2'-O-methyluridine-3'- phosphorothioate
  source 1..23: mol_type = other RNA
agtggaatcgaaagtgttgactc

SEQ ID NO: 979 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 5: mod_base = OTHER; note = 2`-deoxyguanosine -3`-phosphate
  modified_base 7: mod_base = OTHER; note = Adenosine-glycol nucleic acid (GNA) S-Isomer
  modified_base 14: mod_base = OTHER; note = 2'-fluoroguanosine-3'-phosphate
  modified_base 16: mod_base = OTHER; note = 2'-fluoroguanosine-3'-phosphate
  modified_base 21: mod_base = OTHER; note = 2'-O-methylcytidine-3'-phosphorothioate
  modified_base 22: mod_base = OTHER; note = 2'-O-methyluridine-3'- phosphorothioate
  source 1..23: mol_type = other RNA
agtggaatcgaaagtgttgactc

SEQ ID NO: 980 - RNA, 23 nt, synthetic construct
  modified_base 7: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxycytidine-3`-phosphorothioate
  modified_base 5: mod_base = OTHER; note = 2`-deoxyguanosine-3`-phosphate
  modified_base 7: mod_base = OTHER; note = 2`-deoxythimidine-3`-phosphate
  modified_base 12: mod_base = OTHER; note = 2`-deoxyguanosine-3`-phosphate
  modified_base 14: mod_base = OTHER; note = 2'-fluoroadenosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'- phosphorothioate
  source 1..23: mol_type = other RNA
accggctgaacgtaaggcgacag

SEQ ID NO: 981 - RNA, 23 nt, synthetic construct
  modified_base 7: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluorocytidine-3'-phosphorothioate
  modified_base 5: mod_base = OTHER; note = 2`-deoxyguanosine -3`-phosphate
  modified_base 7: mod_base = OTHER; note = Thymidine-glycol nucleic acid (GNA) S-Isomer
  modified_base 14: mod_base = OTHER; note = 2'-fluoroadenosine-3'-phosphate
  modified_base 16: mod_base = OTHER; note = 2'-fluoroguanosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'- phosphorothioate
  source 1..23: mol_type = other RNA
accggctgaacgtaaggcgacag

SEQ ID NO: 982 - RNA, 23 nt, synthetic construct
  modified_base 12: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxycytidine-3`-phosphorothioate
  modified_base 5: mod_base = OTHER; note = 2`-deoxyguanosine-3`-phosphate
  modified_base 7: mod_base = OTHER; note = 2`-deoxyguanosine-3`-phosphate
  modified_base 12: mod_base = OTHER; note = 2`-deoxythimidine-3`-phosphate
  modified_base 14: mod_base = OTHER; note = 2'-fluoroadenosine-3'-phosphate
  modified_base 21: mod_base = OTHER; note = 2'-O-methylcytidine-3'-phosphorothioate
  modified_base 22: mod_base = OTHER; note = 2'-O-methyluridine-3'- phosphorothioate
  source 1..23: mol_type = other RNA
accggtgacagtgagaacgactg

SEQ ID NO: 983 - RNA, 23 nt, synthetic construct
  modified_base 7: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 5: mod_base = OTHER; note = 2`-deoxyguanosine-3`-phosphate
  modified_base 7: mod_base = OTHER; note = Thymidine-glycol nucleic acid (GNA) S-Isomer
  modified_base 14: mod_base = OTHER; note = 2'-fluoroadenosine-3'-phosphate
  modified_base 16: mod_base = OTHER; note = 2'-fluoroadenosine-3'-phosphate
  modified_base 21: mod_base = OTHER; note = 2'-O-methylcytidine-3'-phosphorothioate
  modified_base 22: mod_base = OTHER; note = 2'-O-methyluridine-3'- phosphorothioate
  source 1..23: mol_type = other RNA
agcgggtcatcgaagacagactc

SEQ ID NO: 984 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxycytidine-3`-phosphorothioate
  modified_base 5: mod_base = OTHER; note = 2`-deoxycytidine-3`-phosphate
  modified_base 7: mod_base = OTHER; note = 2`-deoxycytidine-3`-phosphate
  modified_base 12: mod_base = OTHER; note = 2`-deoxycytidine-3`-phosphate
  modified_base 14: mod_base = OTHER; note = 2'-fluorouridine-3'-phosphate
  modified_base 21: mod_base = OTHER; note = 2'-O-methylcytidine-3'-phosphorothioate
  modified_base 22: mod_base = OTHER; note = 2'-O-methyladenosine-3'- phosphorothioate
  source 1..23: mol_type = other RNA
acgacgcgggtcatcgaagacag

SEQ ID NO: 985 - RNA, 23 nt, synthetic construct
  modified_base 7: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 5: mod_base = OTHER; note = 2`-deoxycytidine-3`-phosphate
  modified_base 7: mod_base = OTHER; note = Thymidine-glycol nucleic acid (GNA) S-Isomer
  modified_base 14: mod_base = OTHER; note = 2'-fluorocytidine-3'-phosphate
  modified_base 16: mod_base = OTHER; note = 2'-fluorouridine-3'-phosphate
  modified_base 21: mod_base = OTHER; note = 2'-O-methylcytidine-3'-phosphorothioate
  modified_base 22: mod_base = OTHER; note = 2'-O-methyluridine-3'- phosphorothioate
  source 1..23: mol_type = other RNA
agggcatcaggacccttgcactg

SEQ ID NO: 986 - RNA, 23 nt, synthetic construct
  modified_base 7: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluorouridine-3'-phosphorothioate
  modified_base 5: mod_base = OTHER; note = 2`-deoxycytidine-3`-phosphate
  modified_base 7: mod_base = OTHER; note = Thymidine-glycol nucleic acid (GNA) S-Isomer
  modified_base 14: mod_base = OTHER; note = 2'-fluoroguanosine-3'-phosphate
  modified_base 16: mod_base = OTHER; note = 2'-fluorocytidine-3'-phosphate
  modified_base 21: mod_base = OTHER; note = 2'-O-methylcytidine-3'-phosphorothioate
  modified_base 22: mod_base = OTHER; note = 2'-O-methyladenosine-3'- phosphorothioate
  source 1..23: mol_type = other RNA
atggcttgttgcggtcaccacag

SEQ ID NO: 987 - RNA, 23 nt, synthetic construct
  modified_base 7: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxycytidine-3`-phosphorothioate
  modified_base 5: mod_base = OTHER; note = 2`-deoxycytidine-3`-phosphate
  modified_base 7: mod_base = OTHER; note = 2`-deoxythimidine-3`-phosphate
  modified_base 12: mod_base = OTHER; note = 2`-deoxyadenosine-3`-phosphate
  modified_base 14: mod_base = OTHER; note = 2'-fluoroguanosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'- phosphorothioate
  source 1..23: mol_type = other RNA
acatcctcctgaaggcgcaacag

SEQ ID NO: 988 - RNA, 23 nt, synthetic construct
  modified_base 7: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluorocytidine-3'-phosphorothioate
  modified_base 5: mod_base = OTHER; note = 2`-deoxyguanosine -3`-phosphate
  modified_base 7: mod_base = OTHER; note = Thymidine-glycol nucleic acid (GNA) S-Isomer
  modified_base 14: mod_base = OTHER; note = 2'-fluoroguanosine-3'-phosphate
  modified_base 16: mod_base = OTHER; note = 2'-fluorocytidine-3'-phosphate
  modified_base 21: mod_base = OTHER; note = 2'-O-methylcytidine-3'-phosphorothioate
  modified_base 22: mod_base = OTHER; note = 2'-O-methyladenosine-3'- phosphorothioate
  source 1..23: mol_type = other RNA
acatcctcctgaaggcgcaacag

SEQ ID NO: 989 - RNA, 23 nt, synthetic construct
  modified_base 7: mod_base = OTHER; note = thymine
  modified_base 12: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxyguanosine-3`-phosphorothioate
  modified_base 5: mod_base = OTHER; note = 2`-deoxycytidine-3`-phosphate
  modified_base 7: mod_base = OTHER; note = 2`-deoxythimidine-3`-phosphate
  modified_base 12: mod_base = OTHER; note = 2`-deoxythimidine -3`-phosphate
  modified_base 14: mod_base = OTHER; note = 2'-fluorouridine-3'-phosphate
  modified_base 21: mod_base = OTHER; note = 2'-O-methyladenosine-3'-phosphorothioate
  modified_base 22: mod_base = OTHER; note = 2'-O-methyluridine-3'- phosphorothioate
  source 1..23: mol_type = other RNA
agctcttcagctttgtacttatg

SEQ ID NO: 990 - RNA, 23 nt, synthetic construct
  modified_base 7: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 5: mod_base = OTHER; note = 2`-deoxycytidine-3`-phosphate
  modified_base 7: mod_base = OTHER; note = Thymidine-glycol nucleic acid (GNA) S-Isomer
  modified_base 14: mod_base = OTHER; note = 2'-fluorouridine-3'-phosphate
  modified_base 16: mod_base = OTHER; note = 2'-fluorouridine-3'-phosphate
  modified_base 21: mod_base = OTHER; note = 2'-O-methyladenosine-3'-phosphorothioate
  modified_base 22: mod_base = OTHER; note = 2'-O-methyluridine-3'- phosphorothioate
  source 1..23: mol_type = other RNA
agctcttcagctttgtacttatg

SEQ ID NO: 991 - RNA, 23 nt, synthetic construct
  modified_base 5: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxycytidine-3`-phosphorothioate
  modified_base 5: mod_base = OTHER; note = 2`-deoxythimidine-3`-phosphate
  modified_base 7: mod_base = OTHER; note = 2`-deoxycytidine-3`-phosphate
  modified_base 12: mod_base = OTHER; note = 2`-deoxycytidine-3`-phosphate
  modified_base 14: mod_base = OTHER; note = 2'-fluoroguanosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'- phosphorothioate
  source 1..23: mol_type = other RNA
acagtacagcgcggcgatgtagg

SEQ ID NO: 992 - RNA, 23 nt, synthetic construct
  modified_base 2: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxythimidine-3`-phosphorothioate
  modified_base 5: mod_base = OTHER; note = 2`-deoxycytidine-3`-phosphate
  modified_base 7: mod_base = OTHER; note = 2`-deoxyguanosine-3`-phosphate
  modified_base 12: mod_base = OTHER; note = 2`-deoxyadenosine -3`-phosphate
  modified_base 14: mod_base = OTHER; note = 2'-fluoroguanosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'- phosphorothioate
  source 1..23: mol_type = other RNA
atcccggatccaggccaggtagt

SEQ ID NO: 993 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxycytidine-3`-phosphorothioate
  modified_base 5: mod_base = OTHER; note = 2`-deoxyadenosine-3`-phosphate
  modified_base 7: mod_base = OTHER; note = 2`-deoxycytidine-3`-phosphate
  modified_base 12: mod_base = OTHER; note = 2`-deoxycytidine-3`-phosphate
  modified_base 14: mod_base = OTHER; note = 2'-fluoroadenosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'- phosphorothioate
  source 1..23: mol_type = other RNA
acggatccaggccaggtagtagg

SEQ ID NO: 994 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 5: mod_base = OTHER; note = 2`-deoxyguanosine -3`-phosphate
  modified_base 7: mod_base = OTHER; note = Adenosine-glycol nucleic acid (GNA) S-Isomer
  modified_base 14: mod_base = OTHER; note = 2'-fluoroadenosine-3'-phosphate
  modified_base 16: mod_base = OTHER; note = 2'-fluorouridine-3'-phosphate
  modified_base 21: mod_base = OTHER; note = 2'-O-methyladenosine-3'-phosphorothioate
  modified_base 22: mod_base = OTHER; note = 2'-O-methylcytidine-3'- phosphorothioate
  source 1..23: mol_type = other RNA
aggtggaatcgaaagtgttgact

SEQ ID NO: 995 - RNA, 23 nt, synthetic construct
  modified_base 7: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 5: mod_base = OTHER; note = 2`-deoxyguanosine-3`-phosphate
  modified_base 7: mod_base = OTHER; note = Thymidine-glycol nucleic acid (GNA) S-Isomer
  modified_base 14: mod_base = OTHER; note = 2'-fluorocytidine-3'-phosphate
  modified_base 16: mod_base = OTHER; note = 2'-fluoroguanosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'- phosphorothioate
  source 1..23: mol_type = other RNA
agatgatgccttgcagggtgagc

SEQ ID NO: 996 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluorouridine-3'-phosphorothioate
  modified_base 5: mod_base = OTHER; note = 2`-deoxyguanosine-3`-phosphate
  modified_base 7: mod_base = OTHER; note = adenosine-glycol nucleic acid (GNA) S-Isomer
  modified_base 14: mod_base = OTHER; note = 2'-fluorocytidine-3'-phosphate
  modified_base 16: mod_base = OTHER; note = 2'-fluoroguanosine-3'-phosphate
  modified_base 21: mod_base = OTHER; note = 2'-O-methyladenosine-3'-phosphorothioate
  modified_base 22: mod_base = OTHER; note = 2'-O-methyladenosine-3'- phosphorothioate
  source 1..23: mol_type = other RNA
attggcaggcacaccggctgaac

SEQ ID NO: 997 - RNA, 23 nt, synthetic construct
  modified_base 7: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluorouridine-3'-phosphorothioate
  modified_base 5: mod_base = OTHER; note = 2`-deoxycytidine-3`-phosphate
  modified_base 7: mod_base = OTHER; note = Thymidine-glycol nucleic acid (GNA) S-Isomer
  modified_base 14: mod_base = OTHER; note = 2'-fluorocytidine-3'-phosphate
  modified_base 16: mod_base = OTHER; note = 2'-fluorouridine-3'-phosphate
  modified_base 21: mod_base = OTHER; note = 2'-O-methyladenosine-3'-phosphorothioate
  modified_base 22: mod_base = OTHER; note = 2'-O-methyladenosine-3'- phosphorothioate
  source 1..23: mol_type = other RNA
atgccgtccgcatcctcctgaag

SEQ ID NO: 998 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxyadenosine-3`-phosphorothioate
  modified_base 5: mod_base = OTHER; note = 2`-deoxyguanosine-3`-phosphate
  modified_base 7: mod_base = OTHER; note = 2`-deoxyadenosine-3`-phosphate
  modified_base 12: mod_base = OTHER; note = 2`-deoxyguanosine -3`-phosphate
  modified_base 14: mod_base = OTHER; note = 2'-fluoroguanosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'- phosphorothioate
  source 1..23: mol_type = other RNA
aagggaaagatgagtccctgagc

SEQ ID NO: 999 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxycytidine-3`-phosphorothioate
  modified_base 5: mod_base = OTHER; note = 2`-deoxyadenosine-3`-phosphate
  modified_base 7: mod_base = OTHER; note = 2`-deoxyadenosine-3`-phosphate
  modified_base 12: mod_base = OTHER; note = 2`-deoxycytidine-3`-phosphate
  modified_base 14: mod_base = OTHER; note = 2'-fluorocytidine-3'-phosphate
  modified_base 21: mod_base = OTHER; note = 2'-O-methyladenosine-3'-phosphorothioate
  modified_base 22: mod_base = OTHER; note = 2'-O-methylguanosine-3'- phosphorothioate
  source 1..23: mol_type = other RNA
acgaagacagactcttgcggagc

SEQ ID NO: 1000 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxycytidine-3`-phosphorothioate
  modified_base 5: mod_base = OTHER; note = 2`-deoxyadenosine-3`-phosphate
  modified_base 7: mod_base = OTHER; note = 2`-deoxycytidine-3`-phosphate
  modified_base 12: mod_base = OTHER; note = 2`-deoxyguanosine-3`-phosphate
  modified_base 14: mod_base = OTHER; note = 2'-fluorocytidine-3'-phosphate
  modified_base 21: mod_base = OTHER; note = 2'-O-methyladenosine-3'-phosphorothioate
  modified_base 22: mod_base = OTHER; note = 2'-O-methylguanosine-3'- phosphorothioate
  source 1..23: mol_type = other RNA
actgaacgtaaggcgacaggagc

SEQ ID NO: 1001 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxyadenosine-3`-phosphorothioate
  modified_base 5: mod_base = OTHER; note = 2`-deoxyguanosine-3`-phosphate
  modified_base 7: mod_base = OTHER; note = 2`-deoxycytidine-3`-phosphate
  modified_base 12: mod_base = OTHER; note = 2`-deoxycytidine -3`-phosphate
  modified_base 14: mod_base = OTHER; note = 2'-fluorouridine-3'-phosphate
  modified_base 21: mod_base = OTHER; note = 2'-O-methyladenosine-3'-phosphorothioate
  modified_base 22: mod_base = OTHER; note = 2'-O-methylcytidine-3'- phosphorothioate
  source 1..23: mol_type = other RNA
aaccggctgaacgtaaggcgaca

SEQ ID NO: 1002 - RNA, 23 nt, synthetic construct
  modified_base 7: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluorouridine-3'-phosphorothioate
  modified_base 5: mod_base = OTHER; note = 2`-deoxyguanosine-3`-phosphate
  modified_base 7: mod_base = OTHER; note = Thymidine-glycol nucleic acid (GNA) S-Isomer
  modified_base 14: mod_base = OTHER; note = 2'-fluoroguanosine-3'-phosphate
  modified_base 16: mod_base = OTHER; note = 2'-fluorocytidine-3'-phosphate
  modified_base 21: mod_base = OTHER; note = 2'-O-methyladenosine-3'-phosphorothioate
  modified_base 22: mod_base = OTHER; note = 2'-O-methylcytidine-3'- phosphorothioate
  source 1..23: mol_type = other RNA
atgaggtgttgtggacagagaca

SEQ ID NO: 1003 - RNA, 23 nt, synthetic construct
  modified_base 7: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxycytidine-3`-phosphorothioate
  modified_base 5: mod_base = OTHER; note = 2`-deoxycytidine-3`-phosphate
  modified_base 7: mod_base = OTHER; note = 2`-deoxythimidine-3`-phosphate
  modified_base 12: mod_base = OTHER; note = 2`-deoxyguanosine-3`-phosphate
  modified_base 14: mod_base = OTHER; note = 2'-fluoroguanosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'- phosphorothioate
  source 1..23: mol_type = other RNA
acctcctgaaggcgcaacagagc

SEQ ID NO: 1004 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxyguanosine-3`-phosphorothioate
  modified_base 5: mod_base = OTHER; note = 2`-deoxycytidine-3`-phosphate
  modified_base 7: mod_base = OTHER; note = 2`-deoxyadenosine-3`-phosphate
  modified_base 12: mod_base = OTHER; note = 2`-deoxyguanosine -3`-phosphate
  modified_base 14: mod_base = OTHER; note = 2'-fluoroguanosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'- phosphorothioate
  source 1..23: mol_type = other RNA
agaacgactgtgtgctcttcagc

SEQ ID NO: 1005 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxyadenosine-3`-phosphorothioate
  modified_base 5: mod_base = OTHER; note = 2`-deoxyguanosine-3`-phosphate
  modified_base 7: mod_base = OTHER; note = 2`-deoxyadenosine-3`-phosphate
  modified_base 12: mod_base = OTHER; note = 2`-deoxycytidine -3`-phosphate
  modified_base 14: mod_base = OTHER; note = 2'-fluoroguanosine-3'-phosphate
  modified_base 21: mod_base = OTHER; note = 2'-O-methyladenosine-3'-phosphorothioate
  modified_base 22: mod_base = OTHER; note = 2'-O-methyladenosine-3'- phosphorothioate
  source 1..23: mol_type = other RNA
aaccggagaagctgaggctcaaa

SEQ ID NO: 1006 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 5: mod_base = OTHER; note = 2`-deoxyguanosine -3`-phosphate
  modified_base 7: mod_base = OTHER; note = Adenosine-glycol nucleic acid (GNA) S-Isomer
  modified_base 14: mod_base = OTHER; note = 2'-fluorocytidine-3'-phosphate
  modified_base 16: mod_base = OTHER; note = 2'-fluoroadenosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'- phosphorothioate
  source 1..23: mol_type = other RNA
agtcgcagtactcccagctcagc

SEQ ID NO: 1007 - RNA, 23 nt, synthetic construct
  modified_base 5: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 5: mod_base = OTHER; note = 2`-deoxythymidine -3`-phosphate
  modified_base 7: mod_base = OTHER; note = Adenosine-glycol nucleic acid (GNA) S-Isomer
  modified_base 14: mod_base = OTHER; note = 2'-fluoroguanosine-3'-phosphate
  modified_base 16: mod_base = OTHER; note = 2'-fluorocytidine-3'-phosphate
  modified_base 21: mod_base = OTHER; note = 2'-O-methyladenosine-3'-phosphorothioate
  modified_base 22: mod_base = OTHER; note = 2'-O-methyluridine-3'- phosphorothioate
  source 1..23: mol_type = other RNA
aagctgagcccgcggccatcata

SEQ ID NO: 1008 - RNA, 23 nt, synthetic construct
  modified_base 7: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxycytidine-3`-phosphorothioate
  modified_base 5: mod_base = OTHER; note = 2`-deoxyguanosine-3`-phosphate
  modified_base 7: mod_base = OTHER; note = 2`-deoxythimidine-3`-phosphate
  modified_base 12: mod_base = OTHER; note = 2`-deoxyadenosine-3`-phosphate
  modified_base 14: mod_base = OTHER; note = 2'-fluoroguanosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'- phosphorothioate
  source 1..23: mol_type = other RNA
accagctgatgatgccttgcagg

SEQ ID NO: 1009 - RNA, 23 nt, synthetic construct
  modified_base 7: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluorocytidine-3'-phosphorothioate
  modified_base 5: mod_base = OTHER; note = 2`-deoxyguanosine -3`-phosphate
  modified_base 7: mod_base = OTHER; note = Thymidine-glycol nucleic acid (GNA) S-Isomer
  modified_base 14: mod_base = OTHER; note = 2'-fluoroguanosine-3'-phosphate
  modified_base 16: mod_base = OTHER; note = 2'-fluorocytidine-3'-phosphate
  modified_base 21: mod_base = OTHER; note = 2'-O-methyladenosine-3'-phosphorothioate
  modified_base 22: mod_base = OTHER; note = 2'-O-methylguanosine-3'- phosphorothioate
  source 1..23: mol_type = other RNA
accagctgatgatgccttgcagg

SEQ ID NO: 1010 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluorouridine-3'-phosphorothioate
  modified_base 5: mod_base = OTHER; note = 2`-deoxyguanosine-3`-phosphate
  modified_base 7: mod_base = OTHER; note = adenosine-glycol nucleic acid (GNA) S-Isomer
  modified_base 14: mod_base = OTHER; note = 2'-fluorocytidine-3'-phosphate
  modified_base 16: mod_base = OTHER; note = 2'-fluorocytidine-3'-phosphate
  modified_base 21: mod_base = OTHER; note = 2'-O-methyladenosine-3'-phosphorothioate
  modified_base 22: mod_base = OTHER; note = 2'-O-methylcytidine-3'- phosphorothioate
  source 1..23: mol_type = other RNA
atgggcatcaggacccttgcact

SEQ ID NO: 1011 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluorouridine-3'-phosphorothioate
  modified_base 5: mod_base = OTHER; note = 2`-deoxyguanosine-3`-phosphate
  modified_base 7: mod_base = OTHER; note = adenosine-glycol nucleic acid (GNA) S-Isomer
  modified_base 14: mod_base = OTHER; note = 2'-fluorocytidine-3'-phosphate
  modified_base 16: mod_base = OTHER; note = 2'-fluorocytidine-3'-phosphate
  modified_base 21: mod_base = OTHER; note = 2'-O-methyladenosine-3'-phosphorothioate
  modified_base 22: mod_base = OTHER; note = 2'-O-methyluridine-3'- phosphorothioate
  source 1..23: mol_type = other RNA
atcaggacccttgcactggcatc

SEQ ID NO: 1012 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 5: mod_base = OTHER; note = 2`-deoxyguanosine -3`-phosphate
  modified_base 7: mod_base = OTHER; note = Adenosine-glycol nucleic acid (GNA) S-Isomer
  modified_base 14: mod_base = OTHER; note = 2'-fluorouridine-3'-phosphate
  modified_base 16: mod_base = OTHER; note = 2'-fluoroadenosine-3'-phosphate
  modified_base 21: mod_base = OTHER; note = 2'-O-methyladenosine-3'-phosphorothioate
  modified_base 22: mod_base = OTHER; note = 2'-O-methyluridine-3'- phosphorothioate
  source 1..23: mol_type = other RNA
agcagcagagccctcatggcatc

SEQ ID NO: 1013 - RNA, 23 nt, synthetic construct
  modified_base 12: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxycytidine-3`-phosphorothioate
  modified_base 5: mod_base = OTHER; note = 2`-deoxyadenosine-3`-phosphate
  modified_base 7: mod_base = OTHER; note = 2`-deoxycytidine-3`-phosphate
  modified_base 12: mod_base = OTHER; note = 2`-deoxythimidine-3`-phosphate
  modified_base 14: mod_base = OTHER; note = 2'-fluoroadenosine-3'-phosphate
  modified_base 21: mod_base = OTHER; note = 2'-O-methyladenosine-3'-phosphorothioate
  modified_base 22: mod_base = OTHER; note = 2'-O-methyladenosine-3'- phosphorothioate
  source 1..23: mol_type = other RNA
acgcatcctcctgaaggcgcaac

SEQ ID NO: 1014 - RNA, 23 nt, synthetic construct
  modified_base 12: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxyguanosine-3`-phosphorothioate
  modified_base 5: mod_base = OTHER; note = 2`-deoxyadenosine-3`-phosphate
  modified_base 7: mod_base = OTHER; note = 2`-deoxyadenosine-3`-phosphate
  modified_base 12: mod_base = OTHER; note = 2`-deoxythimidine -3`-phosphate
  modified_base 14: mod_base = OTHER; note = 2'-fluorocytidine-3'-phosphate
  modified_base 21: mod_base = OTHER; note = 2'-O-methyladenosine-3'-phosphorothioate
  modified_base 22: mod_base = OTHER; note = 2'-O-methyladenosine-3'- phosphorothioate
  source 1..23: mol_type = other RNA
agaaagatgagtccctgagcaat

SEQ ID NO: 1015 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 5: mod_base = OTHER; note = 2`-deoxyadenosine -3`-phosphate
  modified_base 7: mod_base = OTHER; note = Adenosine-glycol nucleic acid (GNA) S-Isomer
  modified_base 14: mod_base = OTHER; note = 2'-fluorocytidine-3'-phosphate
  modified_base 16: mod_base = OTHER; note = 2'-fluorouridine-3'-phosphate
  modified_base 21: mod_base = OTHER; note = 2'-O-methyladenosine-3'-phosphorothioate
  modified_base 22: mod_base = OTHER; note = 2'-O-methyladenosine-3'- phosphorothioate
  source 1..23: mol_type = other RNA
agaaagatgagtccctgagcaat

SEQ ID NO: 1016 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxyadenosine-3`-phosphorothioate
  modified_base 5: mod_base = OTHER; note = 2`-deoxycytidine-3`-phosphate
  modified_base 7: mod_base = OTHER; note = 2`-deoxyadenosine-3`-phosphate
  modified_base 12: mod_base = OTHER; note = 2`-deoxyguanosine -3`-phosphate
  modified_base 14: mod_base = OTHER; note = 2'-fluorouridine-3'-phosphate
  modified_base 21: mod_base = OTHER; note = 2'-O-methyladenosine-3'-phosphorothioate
  modified_base 22: mod_base = OTHER; note = 2'-O-methyladenosine-3'- phosphorothioate
  source 1..23: mol_type = other RNA
aaatcgaaagtgttgactccaag

SEQ ID NO: 1017 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluorocytidine-3'-phosphorothioate
  modified_base 5: mod_base = OTHER; note = 2`-deoxyguanosine -3`-phosphate
  modified_base 7: mod_base = OTHER; note = Adenosine-glycol nucleic acid (GNA) S-Isomer
  modified_base 14: mod_base = OTHER; note = 2'-fluorouridine-3'-phosphate
  modified_base 16: mod_base = OTHER; note = 2'-fluorouridine-3'-phosphate
  modified_base 21: mod_base = OTHER; note = 2'-O-methyladenosine-3'-phosphorothioate
  modified_base 22: mod_base = OTHER; note = 2'-O-methylcytidine-3'- phosphorothioate
  source 1..23: mol_type = other RNA
acttgcactggcatctggccaca

SEQ ID NO: 1018 - RNA, 23 nt, synthetic construct
  modified_base 12: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxycytidine-3`-phosphorothioate
  modified_base 5: mod_base = OTHER; note = 2`-deoxyguanosine-3`-phosphate
  modified_base 7: mod_base = OTHER; note = 2`-deoxycytidine-3`-phosphate
  modified_base 12: mod_base = OTHER; note = 2`-deoxythimidine-3`-phosphate
  modified_base 14: mod_base = OTHER; note = 2'-fluoroguanosine-3'-phosphate
  modified_base 21: mod_base = OTHER; note = 2'-O-methyladenosine-3'-phosphorothioate
  modified_base 22: mod_base = OTHER; note = 2'-O-methylcytidine-3'- phosphorothioate
  source 1..23: mol_type = other RNA
accaggccaggtagtaggccaca

SEQ ID NO: 1019 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxycytidine-3`-phosphorothioate
  modified_base 5: mod_base = OTHER; note = 2`-deoxyadenosine-3`-phosphate
  modified_base 7: mod_base = OTHER; note = 2`-deoxyguanosine-3`-phosphate
  modified_base 12: mod_base = OTHER; note = 2`-deoxyadenosine-3`-phosphate
  modified_base 14: mod_base = OTHER; note = 2'-fluorocytidine-3'-phosphate
  modified_base 21: mod_base = OTHER; note = 2'-O-methyladenosine-3'-phosphorothioate
  modified_base 22: mod_base = OTHER; note = 2'-O-methylguanosine-3'- phosphorothioate
  source 1..23: mol_type = other RNA
actgaaggcgcaacagagccagg

SEQ ID NO: 1020 - RNA, 23 nt, synthetic construct
  modified_base 7: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluorocytidine-3'-phosphorothioate
  modified_base 5: mod_base = OTHER; note = 2`-deoxyguanosine -3`-phosphate
  modified_base 7: mod_base = OTHER; note = Thymidine-glycol nucleic acid (GNA) S-Isomer
  modified_base 14: mod_base = OTHER; note = 2'-fluoroguanosine-3'-phosphate
  modified_base 16: mod_base = OTHER; note = 2'-fluorouridine-3'-phosphate
  modified_base 21: mod_base = OTHER; note = 2'-O-methyladenosine-3'-phosphorothioate
  modified_base 22: mod_base = OTHER; note = 2'-O-methylcytidine-3'- phosphorothioate
  source 1..23: mol_type = other RNA
actggcttgttgcggtcaccaca

SEQ ID NO: 1021 - RNA, 23 nt, synthetic construct
  modified_base 7: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 5: mod_base = OTHER; note = 2`-deoxyguanosine-3`-phosphate
  modified_base 7: mod_base = OTHER; note = Thymidine-glycol nucleic acid (GNA) S-Isomer
  modified_base 14: mod_base = OTHER; note = 2'-fluoroguanosine-3'-phosphate
  modified_base 16: mod_base = OTHER; note = 2'-fluoroguanosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'- phosphorothioate
  source 1..23: mol_type = other RNA
agtgggtacatttgtggtacagc

SEQ ID NO: 1022 - RNA, 23 nt, synthetic construct
  modified_base 5: mod_base = OTHER; note = thymine
  modified_base 7: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 5: mod_base = OTHER; note = 2`-deoxythymidine -3`-phosphate
  modified_base 7: mod_base = OTHER; note = Thymidine-glycol nucleic acid (GNA) S-Isomer
  modified_base 14: mod_base = OTHER; note = 2'-fluorocytidine-3'-phosphate
  modified_base 16: mod_base = OTHER; note = 2'-fluoroguanosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'- phosphorothioate
  source 1..23: mol_type = other RNA
aaggtgttgtggacagagacagt

SEQ ID NO: 1023 - RNA, 23 nt, synthetic construct
  modified_base 7: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluorouridine-3'-phosphorothioate
  modified_base 5: mod_base = OTHER; note = 2`-deoxyadenosine-3`-phosphate
  modified_base 7: mod_base = OTHER; note = Thymidine-glycol nucleic acid (GNA) S-Isomer
  modified_base 14: mod_base = OTHER; note = 2'-fluorouridine-3'-phosphate
  modified_base 16: mod_base = OTHER; note = 2'-fluoroguanosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'- phosphorothioate
  source 1..23: mol_type = other RNA
atgcactggcatctggccacagc

SEQ ID NO: 1024 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 5: mod_base = OTHER; note = 2`-deoxyadenosine -3`-phosphate
  modified_base 7: mod_base = OTHER; note = Adenosine-glycol nucleic acid (GNA) S-Isomer
  modified_base 14: mod_base = OTHER; note = 2'-fluoroguanosine-3'-phosphate
  modified_base 16: mod_base = OTHER; note = 2'-fluoroadenosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'- phosphorothioate
  source 1..23: mol_type = other RNA
aggcacaccggctgaacgtaagg

SEQ ID NO: 1025 - RNA, 23 nt, synthetic construct
  modified_base 7: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 5: mod_base = OTHER; note = 2`-deoxycytidine-3`-phosphate
  modified_base 7: mod_base = OTHER; note = Thymidine-glycol nucleic acid (GNA) S-Isomer
  modified_base 14: mod_base = OTHER; note = 2'-fluoroguanosine-3'-phosphate
  modified_base 16: mod_base = OTHER; note = 2'-fluorocytidine-3'-phosphate
  modified_base 21: mod_base = OTHER; note = 2'-O-methyladenosine-3'-phosphorothioate
  modified_base 22: mod_base = OTHER; note = 2'-O-methylguanosine-3'- phosphorothioate
  source 1..23: mol_type = other RNA
agggcatgagtgggacatgaagc

SEQ ID NO: 1026 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxycytidine-3`-phosphorothioate
  modified_base 5: mod_base = OTHER; note = 2`-deoxycytidine-3`-phosphate
  modified_base 7: mod_base = OTHER; note = 2`-deoxyadenosine-3`-phosphate
  modified_base 12: mod_base = OTHER; note = 2`-deoxyguanosine-3`-phosphate
  modified_base 14: mod_base = OTHER; note = 2'-fluorouridine-3'-phosphate
  modified_base 21: mod_base = OTHER; note = 2'-O-methyladenosine-3'-phosphorothioate
  modified_base 22: mod_base = OTHER; note = 2'-O-methylguanosine-3'- phosphorothioate
  source 1..23: mol_type = other RNA
acaacgacgcgggtcatcgaaga

SEQ ID NO: 1027 - RNA, 23 nt, synthetic construct
  modified_base 12: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxycytidine-3`-phosphorothioate
  modified_base 5: mod_base = OTHER; note = 2`-deoxyguanosine-3`-phosphate
  modified_base 7: mod_base = OTHER; note = 2`-deoxyguanosine-3`-phosphate
  modified_base 12: mod_base = OTHER; note = 2`-deoxythimidine-3`-phosphate
  modified_base 14: mod_base = OTHER; note = 2'-fluoroadenosine-3'-phosphate
  modified_base 21: mod_base = OTHER; note = 2'-O-methyladenosine-3'-phosphorothioate
  modified_base 22: mod_base = OTHER; note = 2'-O-methyladenosine-3'- phosphorothioate
  source 1..23: mol_type = other RNA
accggagaagctgaggctcaaag

SEQ ID NO: 1028 - RNA, 23 nt, synthetic construct
  modified_base 7: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2'-fluorouridine-3'-phosphorothioate
  modified_base 5: mod_base = OTHER; note = 2`-deoxyadenosine-3`-phosphate
  modified_base 7: mod_base = OTHER; note = Thymidine-glycol nucleic acid (GNA) S-Isomer
  modified_base 14: mod_base = OTHER; note = 2'-fluoroguanosine-3'-phosphate
  modified_base 16: mod_base = OTHER; note = 2'-fluorocytidine-3'-phosphate
  modified_base 21: mod_base = OTHER; note = 2'-O-methyladenosine-3'-phosphorothioate
  modified_base 22: mod_base = OTHER; note = 2'-O-methyladenosine-3'- phosphorothioate
  source 1..23: mol_type = other RNA
attcactttcttgggctccaaac

SEQ ID NO: 1029 - RNA, 23 nt, synthetic construct
  modified_base 12: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxyadenosine-3`-phosphorothioate
  modified_base 5: mod_base = OTHER; note = 2`-deoxyguanosine-3`-phosphate
  modified_base 7: mod_base = OTHER; note = 2`-deoxyadenosine-3`-phosphate
  modified_base 12: mod_base = OTHER; note = 2`-deoxythimidine -3`-phosphate
  modified_base 14: mod_base = OTHER; note = 2'-fluoroguanosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'- phosphorothioate
  source 1..23: mol_type = other RNA
aatcgaaagtgttgactccaagc

SEQ ID NO: 1030 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxycytidine-3`-phosphorothioate
  modified_base 5: mod_base = OTHER; note = 2`-deoxyadenosine-3`-phosphate
  modified_base 7: mod_base = OTHER; note = 2`-deoxyadenosine-3`-phosphate
  modified_base 12: mod_base = OTHER; note = 2`-deoxyguanosine-3`-phosphate
  modified_base 14: mod_base = OTHER; note = 2'-fluoroguanosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'- phosphorothioate
  source 1..23: mol_type = other RNA
acggagaagctgaggctcaaagc

SEQ ID NO: 1031 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxyguanosine-3`-phosphorothioate
  modified_base 5: mod_base = OTHER; note = 2`-deoxyadenosine-3`-phosphate
  modified_base 7: mod_base = OTHER; note = 2`-deoxycytidine-3`-phosphate
  modified_base 12: mod_base = OTHER; note = 2`-deoxyguanosine -3`-phosphate
  modified_base 14: mod_base = OTHER; note = 2'-fluoroguanosine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  source 1..23: mol_type = other RNA
agagaacgactgtgtgctcttct

SEQ ID NO: 1032 - RNA, 23 nt, synthetic construct
  modified_base 5: mod_base = OTHER; note = thymine
  modified_base 7: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxycytidine-3`-phosphorothioate
  modified_base 5: mod_base = OTHER; note = 2`-deoxythimidine-3`-phosphate
  modified_base 7: mod_base = OTHER; note = 2`-deoxythimidine-3`-phosphate
  modified_base 12: mod_base = OTHER; note = 2`-deoxyguanosine-3`-phosphate
  modified_base 14: mod_base = OTHER; note = 2'-fluoroadenosine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  source 1..23: mol_type = other RNA
acattttcaaagcactttattct

SEQ ID NO: 1033 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxycytidine-3`-phosphorothioate
  modified_base 5: mod_base = OTHER; note = 2`-deoxyguanosine-3`-phosphate
  modified_base 7: mod_base = OTHER; note = 2`-deoxyadenosine-3`-phosphate
  modified_base 12: mod_base = OTHER; note = 2`-deoxyguanosine-3`-phosphate
  modified_base 14: mod_base = OTHER; note = 2'-fluoroguanosine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  source 1..23: mol_type = other RNA
accagtacagcgcggcgatgtct

SEQ ID NO: 1034 - RNA, 23 nt, synthetic construct
  modified_base 12: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxycytidine-3`-phosphorothioate
  modified_base 5: mod_base = OTHER; note = 2`-deoxyadenosine-3`-phosphate
  modified_base 7: mod_base = OTHER; note = 2`-deoxycytidine-3`-phosphate
  modified_base 12: mod_base = OTHER; note = 2`-deoxythimidine-3`-phosphate
  modified_base 14: mod_base = OTHER; note = 2'-fluoroguanosine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  source 1..23: mol_type = other RNA
acagagccaggtcgtgctggtct

SEQ ID NO: 1035 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxycytidine-3`-phosphorothioate
  modified_base 5: mod_base = OTHER; note = 2`-deoxyadenosine-3`-phosphate
  modified_base 7: mod_base = OTHER; note = 2`-deoxyguanosine-3`-phosphate
  modified_base 12: mod_base = OTHER; note = 2`-deoxycytidine-3`-phosphate
  modified_base 14: mod_base = OTHER; note = 2'-fluorouridine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  source 1..23: mol_type = other RNA
actgatgatgccttgcagggtct

SEQ ID NO: 1036 - RNA, 23 nt, synthetic construct
  modified_base 12: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxyguanosine-3`-phosphorothioate
  modified_base 5: mod_base = OTHER; note = 2`-deoxyguanosine-3`-phosphate
  modified_base 7: mod_base = OTHER; note = 2`-deoxycytidine-3`-phosphate
  modified_base 12: mod_base = OTHER; note = 2`-deoxythimidine -3`-phosphate
  modified_base 14: mod_base = OTHER; note = 2'-fluoroguanosine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  source 1..23: mol_type = other RNA
agacgcctggcttgttgcggtct

SEQ ID NO: 1037 - RNA, 23 nt, synthetic construct
  modified_base 7: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxycytidine-3`-phosphorothioate
  modified_base 5: mod_base = OTHER; note = 2`-deoxyguanosine-3`-phosphate
  modified_base 7: mod_base = OTHER; note = 2`-deoxythimidine-3`-phosphate
  modified_base 12: mod_base = OTHER; note = 2`-deoxyguanosine-3`-phosphate
  modified_base 14: mod_base = OTHER; note = 2'-fluorocytidine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  source 1..23: mol_type = other RNA
accggatccaggccaggtagtct

SEQ ID NO: 1038 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxyadenosine-3`-phosphorothioate
  modified_base 5: mod_base = OTHER; note = 2`-deoxyadenosine-3`-phosphate
  modified_base 7: mod_base = OTHER; note = 2`-deoxyguanosine-3`-phosphate
  modified_base 12: mod_base = OTHER; note = 2`-deoxycytidine -3`-phosphate
  modified_base 14: mod_base = OTHER; note = 2'-fluorouridine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  source 1..23: mol_type = other RNA
aaagatgagtccctgagcaatct

SEQ ID NO: 1039 - RNA, 23 nt, synthetic construct
  modified_base 12: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxyguanosine-3`-phosphorothioate
  modified_base 5: mod_base = OTHER; note = 2`-deoxyguanosine-3`-phosphate
  modified_base 7: mod_base = OTHER; note = 2`-deoxyadenosine-3`-phosphate
  modified_base 12: mod_base = OTHER; note = 2`-deoxythimidine -3`-phosphate
  modified_base 14: mod_base = OTHER; note = 2'-fluoroadenosine-3'-phosphate
  modified_base 21: mod_base = OTHER; note = 2'-O-methylguanosine-3'-phosphorothioate
  modified_base 22: mod_base = OTHER; note = 2'-O-methylcytidine-3'- phosphorothioate
  source 1..23: mol_type = other RNA
agagggaaagatgagtccctgct

SEQ ID NO: 1040 - RNA, 23 nt, synthetic construct
  modified_base 5: mod_base = OTHER; note = thymine
  modified_base 7: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxycytidine-3`-phosphorothioate
  modified_base 5: mod_base = OTHER; note = 2`-deoxythimidine-3`-phosphate
  modified_base 7: mod_base = OTHER; note = 2`-deoxythimidine-3`-phosphate
  modified_base 12: mod_base = OTHER; note = 2`-deoxyadenosine-3`-phosphate
  modified_base 14: mod_base = OTHER; note = 2'-fluoroadenosine-3'-phosphate
  modified_base 21: mod_base = OTHER; note = 2'-O-methylguanosine-3'-phosphorothioate
  modified_base 22: mod_base = OTHER; note = 2'-O-methylcytidine-3'- phosphorothioate
  source 1..23: mol_type = other RNA
accttgtgggtacatttgtggct

SEQ ID NO: 1041 - RNA, 23 nt, synthetic construct
  modified_base 2: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxythimidine-3`-phosphorothioate
  modified_base 5: mod_base = OTHER; note = 2`-deoxyadenosine-3`-phosphate
  modified_base 7: mod_base = OTHER; note = 2`-deoxyguanosine-3`-phosphate
  modified_base 12: mod_base = OTHER; note = 2`-deoxyadenosine -3`-phosphate
  modified_base 14: mod_base = OTHER; note = 2'-fluorouridine-3'-phosphate
  modified_base 21: mod_base = OTHER; note = 2'-O-methylguanosine-3'-phosphorothioate
  modified_base 22: mod_base = OTHER; note = 2'-O-methylcytidine-3'- phosphorothioate
  source 1..23: mol_type = other RNA
atcgaagacagactcttgcggct

SEQ ID NO: 1042 - RNA, 23 nt, synthetic construct
  modified_base 2: mod_base = OTHER; note = thymine
  modified_base 7: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxythimidine-3`-phosphorothioate
  modified_base 5: mod_base = OTHER; note = 2`-deoxycytidine-3`-phosphate
  modified_base 7: mod_base = OTHER; note = 2`-deoxythimidine-3`-phosphate
  modified_base 12: mod_base = OTHER; note = 2`-deoxycytidine -3`-phosphate
  modified_base 14: mod_base = OTHER; note = 2'-fluoroguanosine-3'-phosphate
  modified_base 21: mod_base = OTHER; note = 2'-O-methylguanosine-3'-phosphorothioate
  modified_base 22: mod_base = OTHER; note = 2'-O-methylcytidine-3'- phosphorothioate
  source 1..23: mol_type = other RNA
atgtcgttgtccgggttccggct

SEQ ID NO: 1043 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxyguanosine-3`-phosphorothioate
  modified_base 5: mod_base = OTHER; note = 2`-deoxyguanosine-3`-phosphate
  modified_base 7: mod_base = OTHER; note = 2`-deoxyadenosine-3`-phosphate
  modified_base 12: mod_base = OTHER; note = 2`-deoxyadenosine -3`-phosphate
  modified_base 14: mod_base = OTHER; note = 2'-fluoroguanosine-3'-phosphate
  modified_base 21: mod_base = OTHER; note = 2'-O-methylguanosine-3'-phosphorothioate
  modified_base 22: mod_base = OTHER; note = 2'-O-methylcytidine-3'- phosphorothioate
  source 1..23: mol_type = other RNA
agctgaacgtaaggcgacaggct

SEQ ID NO: 1044 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxycytidine-3`-phosphorothioate
  modified_base 5: mod_base = OTHER; note = 2`-deoxycytidine-3`-phosphate
  modified_base 7: mod_base = OTHER; note = 2`-deoxyguanosine-3`-phosphate
  modified_base 12: mod_base = OTHER; note = 2`-deoxyadenosine-3`-phosphate
  modified_base 14: mod_base = OTHER; note = 2'-fluoroguanosine-3'-phosphate
  modified_base 21: mod_base = OTHER; note = 2'-O-methylguanosine-3'-phosphorothioate
  modified_base 22: mod_base = OTHER; note = 2'-O-methylcytidine-3'- phosphorothioate
  source 1..23: mol_type = other RNA
acaccggctgaacgtaaggcgct

SEQ ID NO: 1045 - RNA, 23 nt, synthetic construct
  modified_base 2: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxythimidine-3`-phosphorothioate
  modified_base 5: mod_base = OTHER; note = 2`-deoxyguanosine-3`-phosphate
  modified_base 7: mod_base = OTHER; note = 2`-deoxyadenosine-3`-phosphate
  modified_base 12: mod_base = OTHER; note = 2`-deoxycytidine -3`-phosphate
  modified_base 14: mod_base = OTHER; note = 2'-fluorocytidine-3'-phosphate
  modified_base 21: mod_base = OTHER; note = 2'-O-methylguanosine-3'-phosphorothioate
  modified_base 22: mod_base = OTHER; note = 2'-O-methylcytidine-3'- phosphorothioate
  source 1..23: mol_type = other RNA
atccggaatcaccctggcacgct

SEQ ID NO: 1046 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxycytidine-3`-phosphorothioate
  modified_base 5: mod_base = OTHER; note = 2`-deoxyguanosine-3`-phosphate
  modified_base 7: mod_base = OTHER; note = 2`-deoxyadenosine-3`-phosphate
  modified_base 12: mod_base = OTHER; note = 2`-deoxyguanosine-3`-phosphate
  modified_base 14: mod_base = OTHER; note = 2'-fluorocytidine-3'-phosphate
  modified_base 21: mod_base = OTHER; note = 2'-O-methylguanosine-3'-phosphorothioate
  modified_base 22: mod_base = OTHER; note = 2'-O-methylcytidine-3'- phosphorothioate
  source 1..23: mol_type = other RNA
acccggatccaggccaggtagct

SEQ ID NO: 1047 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxyguanosine-3`-phosphorothioate
  modified_base 5: mod_base = OTHER; note = 2`-deoxyadenosine-3`-phosphate
  modified_base 7: mod_base = OTHER; note = 2`-deoxyadenosine-3`-phosphate
  modified_base 12: mod_base = OTHER; note = 2`-deoxyadenosine -3`-phosphate
  modified_base 14: mod_base = OTHER; note = 2'-fluorouridine-3'-phosphate
  modified_base 21: mod_base = OTHER; note = 2'-O-methylguanosine-3'-phosphorothioate
  modified_base 22: mod_base = OTHER; note = 2'-O-methylcytidine-3'- phosphorothioate
  source 1..23: mol_type = other RNA
agggaaagatgagtccctgagct

SEQ ID NO: 1048 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxyadenosine-3`-phosphorothioate
  modified_base 5: mod_base = OTHER; note = 2`-deoxyguanosine-3`-phosphate
  modified_base 7: mod_base = OTHER; note = 2`-deoxycytidine-3`-phosphate
  modified_base 12: mod_base = OTHER; note = 2`-deoxyguanosine -3`-phosphate
  modified_base 14: mod_base = OTHER; note = 2'-fluorocytidine-3'-phosphate
  modified_base 21: mod_base = OTHER; note = 2'-O-methylguanosine-3'-phosphorothioate
  modified_base 22: mod_base = OTHER; note = 2'-O-methylcytidine-3'- phosphorothioate
  source 1..23: mol_type = other RNA
aaacgacgcgggtcatcgaagct

SEQ ID NO: 1049 - RNA, 23 nt, synthetic construct
  modified_base 12: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxyadenosine-3`-phosphorothioate
  modified_base 5: mod_base = OTHER; note = 2`-deoxyadenosine-3`-phosphate
  modified_base 7: mod_base = OTHER; note = 2`-deoxyguanosine-3`-phosphate
  modified_base 12: mod_base = OTHER; note = 2`-deoxythimidine -3`-phosphate
  modified_base 14: mod_base = OTHER; note = 2'-fluorouridine-3'-phosphate
  modified_base 21: mod_base = OTHER; note = 2'-O-methylcytidine-3'-phosphorothioate
  modified_base 22: mod_base = OTHER; note = 2'-O-methylcytidine-3'- phosphorothioate
  source 1..23: mol_type = other RNA
aagaacgactgtgtgctcttcct

SEQ ID NO: 1050 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxyadenosine-3`-phosphorothioate
  modified_base 5: mod_base = OTHER; note = 2`-deoxycytidine-3`-phosphate
  modified_base 7: mod_base = OTHER; note = 2`-deoxyguanosine-3`-phosphate
  modified_base 12: mod_base = OTHER; note = 2`-deoxyguanosine -3`-phosphate
  modified_base 14: mod_base = OTHER; note = 2'-fluorouridine-3'-phosphate
  modified_base 21: mod_base = OTHER; note = 2'-O-methylcytidine-3'-phosphorothioate
  modified_base 22: mod_base = OTHER; note = 2'-O-methylcytidine-3'- phosphorothioate
  source 1..23: mol_type = other RNA
aaaccggagaagctgaggctcct

SEQ ID NO: 1051 - RNA, 23 nt, synthetic construct
  modified_base 5: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxycytidine-3`-phosphorothioate
  modified_base 5: mod_base = OTHER; note = 2`-deoxythimidine-3`-phosphate
  modified_base 7: mod_base = OTHER; note = 2`-deoxyguanosine-3`-phosphate
  modified_base 12: mod_base = OTHER; note = 2`-deoxyguanosine-3`-phosphate
  modified_base 14: mod_base = OTHER; note = 2'-fluorocytidine-3'-phosphate
  modified_base 21: mod_base = OTHER; note = 2'-O-methylcytidine-3'-phosphorothioate
  modified_base 22: mod_base = OTHER; note = 2'-O-methylcytidine-3'- phosphorothioate
  source 1..23: mol_type = other RNA
acccttgcactggcatctggcct

SEQ ID NO: 1052 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxyadenosine-3`-phosphorothioate
  modified_base 5: mod_base = OTHER; note = 2`-deoxycytidine-3`-phosphate
  modified_base 7: mod_base = OTHER; note = 2`-deoxyguanosine-3`-phosphate
  modified_base 12: mod_base = OTHER; note = 2`-deoxyadenosine -3`-phosphate
  modified_base 14: mod_base = OTHER; note = 2'-fluorocytidine-3'-phosphate
  modified_base 21: mod_base = OTHER; note = 2'-O-methylcytidine-3'-phosphorothioate
  modified_base 22: mod_base = OTHER; note = 2'-O-methylcytidine-3'- phosphorothioate
  source 1..23: mol_type = other RNA
aacaccggctgaacgtaaggcct

SEQ ID NO: 1053 - RNA, 23 nt, synthetic construct
  modified_base 5: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxyadenosine-3`-phosphorothioate
  modified_base 5: mod_base = OTHER; note = 2`-deoxythimidine-3`-phosphate
  modified_base 7: mod_base = OTHER; note = 2`-deoxyadenosine-3`-phosphate
  modified_base 12: mod_base = OTHER; note = 2`-deoxyguanosine -3`-phosphate
  modified_base 14: mod_base = OTHER; note = 2'-fluorouridine-3'-phosphate
  modified_base 21: mod_base = OTHER; note = 2'-O-methylcytidine-3'-phosphorothioate
  modified_base 22: mod_base = OTHER; note = 2'-O-methylcytidine-3'- phosphorothioate
  source 1..23: mol_type = other RNA
aactttattgagttcctgcgcct

SEQ ID NO: 1054 - RNA, 23 nt, synthetic construct
  modified_base 7: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxycytidine-3`-phosphorothioate
  modified_base 5: mod_base = OTHER; note = 2`-deoxycytidine-3`-phosphate
  modified_base 7: mod_base = OTHER; note = 2`-deoxythimidine-3`-phosphate
  modified_base 12: mod_base = OTHER; note = 2`-deoxycytidine-3`-phosphate
  modified_base 14: mod_base = OTHER; note = 2'-fluoroguanosine-3'-phosphate
  modified_base 21: mod_base = OTHER; note = 2'-O-methylcytidine-3'-phosphorothioate
  modified_base 22: mod_base = OTHER; note = 2'-O-methylcytidine-3'- phosphorothioate
  source 1..23: mol_type = other RNA
accgcatcctcctgaaggcgcct

SEQ ID NO: 1055 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxyguanosine-3`-phosphorothioate
  modified_base 5: mod_base = OTHER; note = 2`-deoxyadenosine-3`-phosphate
  modified_base 7: mod_base = OTHER; note = 2`-deoxyguanosine-3`-phosphate
  modified_base 12: mod_base = OTHER; note = 2`-deoxyguanosine -3`-phosphate
  modified_base 14: mod_base = OTHER; note = 2'-fluorocytidine-3'-phosphate
  modified_base 21: mod_base = OTHER; note = 2'-O-methylcytidine-3'-phosphorothioate
  modified_base 22: mod_base = OTHER; note = 2'-O-methylcytidine-3'- phosphorothioate
  source 1..23: mol_type = other RNA
aggaaagatgagtccctgagcct

SEQ ID NO: 1056 - RNA, 23 nt, synthetic construct
  modified_base 12: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxycytidine-3`-phosphorothioate
  modified_base 5: mod_base = OTHER; note = 2`-deoxyguanosine-3`-phosphate
  modified_base 7: mod_base = OTHER; note = 2`-deoxyadenosine-3`-phosphate
  modified_base 12: mod_base = OTHER; note = 2`-deoxythimidine-3`-phosphate
  modified_base 14: mod_base = OTHER; note = 2'-fluorocytidine-3'-phosphate
  modified_base 21: mod_base = OTHER; note = 2'-O-methylcytidine-3'-phosphorothioate
  modified_base 22: mod_base = OTHER; note = 2'-O-methylcytidine-3'- phosphorothioate
  source 1..23: mol_type = other RNA
acgaggaaccctgcgcagagcct

SEQ ID NO: 1057 - RNA, 23 nt, synthetic construct
  modified_base 2: mod_base = OTHER; note = thymine
  modified_base 5: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxythimidine-3`-phosphorothioate
  modified_base 5: mod_base = OTHER; note = 2`-deoxythimidine-3`-phosphate
  modified_base 7: mod_base = OTHER; note = 2`-deoxyadenosine-3`-phosphate
  modified_base 12: mod_base = OTHER; note = 2`-deoxyguanosine -3`-phosphate
  modified_base 14: mod_base = OTHER; note = 2'-fluoroadenosine-3'-phosphate
  modified_base 21: mod_base = OTHER; note = 2'-O-methylcytidine-3'-phosphorothioate
  modified_base 22: mod_base = OTHER; note = 2'-O-methylcytidine-3'- phosphorothioate
  source 1..23: mol_type = other RNA
atcctgaaggcgcaacagagcct

SEQ ID NO: 1058 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxyguanosine-3`-phosphorothioate
  modified_base 5: mod_base = OTHER; note = 2`-deoxyadenosine-3`-phosphate
  modified_base 7: mod_base = OTHER; note = 2`-deoxyguanosine-3`-phosphate
  modified_base 12: mod_base = OTHER; note = 2`-deoxyguanosine -3`-phosphate
  modified_base 14: mod_base = OTHER; note = 2'-fluorocytidine-3'-phosphate
  modified_base 21: mod_base = OTHER; note = 2'-O-methylcytidine-3'-phosphorothioate
  modified_base 22: mod_base = OTHER; note = 2'-O-methylcytidine-3'- phosphorothioate
  source 1..23: mol_type = other RNA
agagaagctgaggctcaaagcct

SEQ ID NO: 1059 - RNA, 23 nt, synthetic construct
  modified_base 5: mod_base = OTHER; note = thymine
  modified_base 12: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxyguanosine-3`-phosphorothioate
  modified_base 5: mod_base = OTHER; note = 2`-deoxythimidine-3`-phosphate
  modified_base 7: mod_base = OTHER; note = 2`-deoxyguanosine-3`-phosphate
  modified_base 12: mod_base = OTHER; note = 2`-deoxythimidine -3`-phosphate
  modified_base 14: mod_base = OTHER; note = 2'-fluorouridine-3'-phosphate
  modified_base 21: mod_base = OTHER; note = 2'-O-methylcytidine-3'-phosphorothioate
  modified_base 22: mod_base = OTHER; note = 2'-O-methylcytidine-3'- phosphorothioate
  source 1..23: mol_type = other RNA
agaatcgaaagtgttgactccct

SEQ ID NO: 1060 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxycytidine-3`-phosphorothioate
  modified_base 5: mod_base = OTHER; note = 2`-deoxyguanosine-3`-phosphate
  modified_base 7: mod_base = OTHER; note = 2`-deoxyadenosine-3`-phosphate
  modified_base 12: mod_base = OTHER; note = 2`-deoxycytidine-3`-phosphate
  modified_base 14: mod_base = OTHER; note = 2'-fluoroadenosine-3'-phosphate
  modified_base 21: mod_base = OTHER; note = 2'-O-methylcytidine-3'-phosphorothioate
  modified_base 22: mod_base = OTHER; note = 2'-O-methylcytidine-3'- phosphorothioate
  source 1..23: mol_type = other RNA
acctgaaggcgcaacagagccct

SEQ ID NO: 1061 - RNA, 23 nt, synthetic construct
  modified_base 7: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxycytidine-3`-phosphorothioate
  modified_base 5: mod_base = OTHER; note = 2`-deoxyguanosine-3`-phosphate
  modified_base 7: mod_base = OTHER; note = 2`-deoxythimidine-3`-phosphate
  modified_base 12: mod_base = OTHER; note = 2`-deoxyguanosine-3`-phosphate
  modified_base 14: mod_base = OTHER; note = 2'-fluoroadenosine-3'-phosphate
  modified_base 21: mod_base = OTHER; note = 2'-O-methylcytidine-3'-phosphorothioate
  modified_base 22: mod_base = OTHER; note = 2'-O-methylcytidine-3'- phosphorothioate
  source 1..23: mol_type = other RNA
accggctgaacgtaaggcgacct

SEQ ID NO: 1062 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxycytidine-3`-phosphorothioate
  modified_base 5: mod_base = OTHER; note = 2`-deoxycytidine-3`-phosphate
  modified_base 7: mod_base = OTHER; note = 2`-deoxycytidine-3`-phosphate
  modified_base 12: mod_base = OTHER; note = 2`-deoxycytidine-3`-phosphate
  modified_base 14: mod_base = OTHER; note = 2'-fluorouridine-3'-phosphate
  modified_base 21: mod_base = OTHER; note = 2'-O-methylcytidine-3'-phosphorothioate
  modified_base 22: mod_base = OTHER; note = 2'-O-methylcytidine-3'- phosphorothioate
  source 1..23: mol_type = other RNA
acgacgcgggtcatcgaagacct

SEQ ID NO: 1063 - RNA, 23 nt, synthetic construct
  modified_base 7: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxycytidine-3`-phosphorothioate
  modified_base 5: mod_base = OTHER; note = 2`-deoxycytidine-3`-phosphate
  modified_base 7: mod_base = OTHER; note = 2`-deoxycytidine-3`-phosphate
  modified_base 12: mod_base = OTHER; note = 2`-deoxyadenosine-3`-phosphate
  modified_base 14: mod_base = OTHER; note = 2'-fluoroguanosine-3'-phosphate
  modified_base 21: mod_base = OTHER; note = 2'-O-methylcytidine-3'-phosphorothioate
  modified_base 22: mod_base = OTHER; note = 2'-O-methylcytidine-3'- phosphorothioate
  source 1..23: mol_type = other RNA
acatcctcctgaaggcgcaacct

SEQ ID NO: 1064 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxyadenosine-3`-phosphorothioate
  modified_base 5: mod_base = OTHER; note = 2`-deoxyguanosine-3`-phosphate
  modified_base 7: mod_base = OTHER; note = 2`-deoxycytidine-3`-phosphate
  modified_base 12: mod_base = OTHER; note = 2`-deoxycytidine -3`-phosphate
  modified_base 14: mod_base = OTHER; note = 2'-fluorouridine-3'-phosphate
  modified_base 21: mod_base = OTHER; note = 2'-O-methyladenosine-3'-phosphorothioate
  modified_base 22: mod_base = OTHER; note = 2'-O-methylcytidine-3'- phosphorothioate
  source 1..23: mol_type = other RNA
aaccggctgaacgtaaggcgact

SEQ ID NO: 1065 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxyadenosine-3`-phosphorothioate
  modified_base 5: mod_base = OTHER; note = 2`-deoxyguanosine-3`-phosphate
  modified_base 7: mod_base = OTHER; note = 2`-deoxyadenosine-3`-phosphate
  modified_base 12: mod_base = OTHER; note = 2`-deoxycytidine -3`-phosphate
  modified_base 14: mod_base = OTHER; note = 2'-fluoroguanosine-3'-phosphate
  modified_base 21: mod_base = OTHER; note = 2'-O-methyladenosine-3'-phosphorothioate
  modified_base 22: mod_base = OTHER; note = 2'-O-methylcytidine-3'- phosphorothioate
  source 1..23: mol_type = other RNA
aaccggagaagctgaggctcact

SEQ ID NO: 1066 - RNA, 23 nt, synthetic construct
  modified_base 12: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxycytidine-3`-phosphorothioate
  modified_base 5: mod_base = OTHER; note = 2`-deoxyadenosine-3`-phosphate
  modified_base 7: mod_base = OTHER; note = 2`-deoxycytidine-3`-phosphate
  modified_base 12: mod_base = OTHER; note = 2`-deoxythimidine-3`-phosphate
  modified_base 14: mod_base = OTHER; note = 2'-fluoroadenosine-3'-phosphate
  modified_base 21: mod_base = OTHER; note = 2'-O-methyladenosine-3'-phosphorothioate
  modified_base 22: mod_base = OTHER; note = 2'-O-methylcytidine-3'- phosphorothioate
  source 1..23: mol_type = other RNA
acgcatcctcctgaaggcgcact

SEQ ID NO: 1067 - RNA, 23 nt, synthetic construct
  modified_base 12: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxyguanosine-3`-phosphorothioate
  modified_base 5: mod_base = OTHER; note = 2`-deoxyadenosine-3`-phosphate
  modified_base 7: mod_base = OTHER; note = 2`-deoxyadenosine-3`-phosphate
  modified_base 12: mod_base = OTHER; note = 2`-deoxythimidine -3`-phosphate
  modified_base 14: mod_base = OTHER; note = 2'-fluorocytidine-3'-phosphate
  modified_base 21: mod_base = OTHER; note = 2'-O-methyladenosine-3'-phosphorothioate
  modified_base 22: mod_base = OTHER; note = 2'-O-methylcytidine-3'- phosphorothioate
  source 1..23: mol_type = other RNA
agaaagatgagtccctgagcact

SEQ ID NO: 1068 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxyadenosine-3`-phosphorothioate
  modified_base 5: mod_base = OTHER; note = 2`-deoxycytidine-3`-phosphate
  modified_base 7: mod_base = OTHER; note = 2`-deoxyadenosine-3`-phosphate
  modified_base 12: mod_base = OTHER; note = 2`-deoxyguanosine -3`-phosphate
  modified_base 14: mod_base = OTHER; note = 2'-fluorouridine-3'-phosphate
  modified_base 21: mod_base = OTHER; note = 2'-O-methyladenosine-3'-phosphorothioate
  modified_base 22: mod_base = OTHER; note = 2'-O-methylcytidine-3'- phosphorothioate
  source 1..23: mol_type = other RNA
aaatcgaaagtgttgactccact

SEQ ID NO: 1069 - RNA, 23 nt, synthetic construct
  modified_base 12: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxycytidine-3`-phosphorothioate
  modified_base 5: mod_base = OTHER; note = 2`-deoxyguanosine-3`-phosphate
  modified_base 7: mod_base = OTHER; note = 2`-deoxycytidine-3`-phosphate
  modified_base 12: mod_base = OTHER; note = 2`-deoxythimidine-3`-phosphate
  modified_base 14: mod_base = OTHER; note = 2'-fluoroguanosine-3'-phosphate
  modified_base 21: mod_base = OTHER; note = 2'-O-methyladenosine-3'-phosphorothioate
  modified_base 22: mod_base = OTHER; note = 2'-O-methylcytidine-3'- phosphorothioate
  source 1..23: mol_type = other RNA
accaggccaggtagtaggccact

SEQ ID NO: 1070 - RNA, 23 nt, synthetic construct
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxycytidine-3`-phosphorothioate
  modified_base 5: mod_base = OTHER; note = 2`-deoxycytidine-3`-phosphate
  modified_base 7: mod_base = OTHER; note = 2`-deoxyadenosine-3`-phosphate
  modified_base 12: mod_base = OTHER; note = 2`-deoxyguanosine-3`-phosphate
  modified_base 14: mod_base = OTHER; note = 2'-fluorouridine-3'-phosphate
  modified_base 21: mod_base = OTHER; note = 2'-O-methyladenosine-3'-phosphorothioate
  modified_base 22: mod_base = OTHER; note = 2'-O-methylcytidine-3'- phosphorothioate
  source 1..23: mol_type = other RNA
acaacgacgcgggtcatcgaact

SEQ ID NO: 1071 - RNA, 23 nt, synthetic construct
  modified_base 12: mod_base = OTHER; note = thymine
  misc_feature 1..23: note = Synthetic
  modified_base 1: mod_base = OTHER; note = 2'-O-methyladenosine-3'- phosphorothioate
  modified_base 2: mod_base = OTHER; note = 2`-deoxycytidine-3`-phosphorothioate
  modified_base 5: mod_base = OTHER; note = 2`-deoxyguanosine-3`-phosphate
  modified_base 7: mod_base = OTHER; note = 2`-deoxyguanosine-3`-phosphate
  modified_base 12: mod_base = OTHER; note = 2`-deoxythimidine-3`-phosphate
  modified_base 14: mod_base = OTHER; note = 2'-fluoroadenosine-3'-phosphate
  modified_base 21: mod_base = OTHER; note = 2'-O-methyladenosine-3'-phosphorothioate
  modified_base 22: mod_base = OTHER; note = 2'-O-methylcytidine-3'- phosphorothioate
  source 1..23: mol_type = other RNA
accggagaagctgaggctcaact

SEQ ID NO: 1072 - RNA, 23 nt, synthetic construct
  misc_feature 1..23: note = Synthetic
  modified_base 1: mod_base = OTHER; note = 2'-O-methyluridine-3'-phosphorothioate
  modified_base 2: mod_base = OTHER; note = 2'-fluorouridine -3'-phosphorothioate
  modified_base 14: mod_base = OTHER; note = 2'-fluorouridine-3'-phosphate
  modified_base 16: mod_base = OTHER; note = 2'-fluorouridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  source 1..23: mol_type = other RNA
tttcaaagcactttattgagttc

SEQ ID NO: 1073 - RNA, 23 nt, synthetic construct
  misc_feature 1..23: note = Synthetic
  modified_base 1: mod_base = OTHER; note = 2'-O-methyluridine-3'-phosphorothioate
  modified_base 2: mod_base = OTHER; note = 2'-fluorouridine -3'-phosphorothioate
  modified_base 14: mod_base = OTHER; note = 2'-fluorouridine-3'-phosphate
  modified_base 16: mod_base = OTHER; note = 2'-fluorouridine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  source 1..23: mol_type = other RNA
attttcaaagcactttattgagt

SEQ ID NO: 1074 - RNA, 23 nt, synthetic construct
  misc_feature 1..23: note = Synthetic
  modified_base 1: mod_base = OTHER; note = 2'-O-methyluridine-3'-phosphorothioate
  modified_base 2: mod_base = OTHER; note = 2'-fluorouridine -3'-phosphorothioate
  modified_base 14: mod_base = OTHER; note = 2'-fluorouridine-3'-phosphate
  modified_base 16: mod_base = OTHER; note = 2'-fluoroadenosine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  source 1..23: mol_type = other RNA
ttttcaaagcactttattgagtt

SEQ ID NO: 1075 - RNA, 23 nt, synthetic construct
  misc_feature 1..23: note = Synthetic
  modified_base 1: mod_base = OTHER; note = 2'-O-methyluridine-3'-phosphorothioate
  modified_base 2: mod_base = OTHER; note = 2'-fluorocytidine -3'-phosphorothioate
  modified_base 14: mod_base = OTHER; note = 2'-fluorouridine-3'-phosphate
  modified_base 16: mod_base = OTHER; note = 2'-fluoroguanosine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  source 1..23: mol_type = other RNA
tcaaagcactttattgagttcct

SEQ ID NO: 1076 - RNA, 23 nt, synthetic construct
  misc_feature 1..23: note = Synthetic
  modified_base 1: mod_base = OTHER; note = 2'-O-methyladenosine-3'-phosphorothioate
  modified_base 2: mod_base = OTHER; note = 2'-fluorocytidine -3'-phosphorothioate
  modified_base 6: mod_base = OTHER; note = 2'-fluorouridine-3'-phosphate
  modified_base 8: mod_base = OTHER; note = 2'-fluorocytidine-3'-phosphate
  modified_base 9: mod_base = OTHER; note = 2'-fluoroadenosine-3'-phosphate
  modified_base 14: mod_base = OTHER; note = 2'-fluoroadenosine-3'-phosphate
  modified_base 16: mod_base = OTHER; note = 2'-fluorouridine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  source 1..23: mol_type = other RNA
acgttttcaaagcactttattga

SEQ ID NO: 1077 - RNA, 23 nt, synthetic construct
  misc_feature 1..23: note = Synthetic
  source 1..23: mol_type = other RNA
agaaagagaagtgctttgagcct

SEQ ID NO: 1078 - RNA, 23 nt, synthetic construct
  misc_feature 1..23: note = Synthetic
  source 1..23: mol_type = other RNA
acaaatgtacccacaagggccgg

SEQ ID NO: 1079 - RNA, 23 nt, synthetic construct
  misc_feature 1..23: note = Synthetic
  source 1..23: mol_type = other RNA
ggaacccggacaacgacatccgc

SEQ ID NO: 1080 - RNA, 23 nt, synthetic construct
  misc_feature 1..23: note = Synthetic
  source 1..23: mol_type = other RNA
ggaactcaataaagtgctttgaa

SEQ ID NO: 1081 - RNA, 23 nt, synthetic construct
  misc_feature 1..23: note = Synthetic
  source 1..23: mol_type = other RNA
agaactgagcaagcagctgtggc

SEQ ID NO: 1082 - RNA, 23 nt, synthetic construct
  misc_feature 1..23: note = Synthetic
  source 1..23: mol_type = other RNA
acaagaatgagatatggtataga

SEQ ID NO: 1083 - RNA, 23 nt, synthetic construct
  misc_feature 1..23: note = Synthetic
  source 1..23: mol_type = other RNA
tgaagagcacacagtcgttctca

SEQ ID NO: 1084 - RNA, 23 nt, synthetic construct
  misc_feature 1..23: note = Synthetic
  source 1..23: mol_type = other RNA
gcaagcagctgtggccagatgcc

SEQ ID NO: 1085 - RNA, 23 nt, synthetic construct
  misc_feature 1..23: note = Synthetic
  source 1..23: mol_type = other RNA
gcaagctgctatgatggccgcgg

SEQ ID NO: 1086 - RNA, 23 nt, synthetic construct
  misc_feature 1..23: note = Synthetic
  source 1..23: mol_type = other RNA
ataagtacaaagctgaagagcac

SEQ ID NO: 1087 - RNA, 23 nt, synthetic construct
  misc_feature 1..23: note = Synthetic
  source 1..23: mol_type = other RNA
agaagtgctttgagcctcagctt

SEQ ID NO: 1088 - RNA, 23 nt, synthetic construct
  misc_feature 1..23: note = Synthetic
  source 1..23: mol_type = other RNA
tcaataaagtgctttgaaaatgc

SEQ ID NO: 1089 - RNA, 23 nt, synthetic construct
  misc_feature 1..23: note = Synthetic
  source 1..23: mol_type = other RNA
ccacaaatgtacccacaagggcc

SEQ ID NO: 1090 - RNA, 23 nt, synthetic construct
  misc_feature 1..23: note = Synthetic
  source 1..23: mol_type = other RNA
gcacacagtcgttctcactgtca

SEQ ID NO: 1091 - RNA, 23 nt, synthetic construct
  misc_feature 1..23: note = Synthetic
  source 1..23: mol_type = other RNA
ctacaccgatgtggcctactacc

SEQ ID NO: 1092 - RNA, 23 nt, synthetic construct
  misc_feature 1..23: note = Synthetic
  source 1..23: mol_type = other RNA
caacactttcgattccaccttgg

SEQ ID NO: 1093 - RNA, 23 nt, synthetic construct
  misc_feature 1..23: note = Synthetic
  source 1..23: mol_type = other RNA
caacactttcgattccaccttgg

SEQ ID NO: 1094 - RNA, 23 nt, synthetic construct
  misc_feature 1..23: note = Synthetic
  source 1..23: mol_type = other RNA
acacagtcgttctcactgtcacc

SEQ ID NO: 1095 - RNA, 23 nt, synthetic construct
  misc_feature 1..23: note = Synthetic
  source 1..23: mol_type = other RNA
ctacatcgccgcgctgtactggg

SEQ ID NO: 1096 - RNA, 23 nt, synthetic construct
  misc_feature 1..23: note = Synthetic
  source 1..23: mol_type = other RNA
ctaccagcacgacctggctctgt

SEQ ID NO: 1097 - RNA, 23 nt, synthetic construct
  misc_feature 1..23: note = Synthetic
  source 1..23: mol_type = other RNA
gaacccggacaacgacatccgcc

SEQ ID NO: 1098 - RNA, 23 nt, synthetic construct
  misc_feature 1..23: note = Synthetic
  source 1..23: mol_type = other RNA
tcaccctgcaaggcatcatcagc

SEQ ID NO: 1099 - RNA, 23 nt, synthetic construct
  misc_feature 1..23: note = Synthetic
  source 1..23: mol_type = other RNA
tgaccgcaacaagccaggcgtct

SEQ ID NO: 1100 - RNA, 23 nt, synthetic construct
  misc_feature 1..23: note = Synthetic
  source 1..23: mol_type = other RNA
cgacctggctctgttgcgccttc

SEQ ID NO: 1101 - RNA, 23 nt, synthetic construct
  misc_feature 1..23: note = Synthetic
  source 1..23: mol_type = other RNA
ttacgttcagccggtgtgcctgc

SEQ ID NO: 1102 - RNA, 23 nt, synthetic construct
  misc_feature 1..23: note = Synthetic
  source 1..23: mol_type = other RNA
ctactacctggcctggatccggg

SEQ ID NO: 1103 - RNA, 23 nt, synthetic construct
  misc_feature 1..23: note = Synthetic
  source 1..23: mol_type = other RNA
gaactcaataaagtgctttgaaa

SEQ ID NO: 1104 - RNA, 23 nt, synthetic construct
  misc_feature 1..23: note = Synthetic
  source 1..23: mol_type = other RNA
gaactgagcaagcagctgtggcc

SEQ ID NO: 1105 - RNA, 23 nt, synthetic construct
  misc_feature 1..23: note = Synthetic
  source 1..23: mol_type = other RNA
aaagagaagtgctttgagcctca

SEQ ID NO: 1106 - RNA, 23 nt, synthetic construct
  misc_feature 1..23: note = Synthetic
  source 1..23: mol_type = other RNA
gaagagcacacagtcgttctcac

SEQ ID NO: 1107 - RNA, 23 nt, synthetic construct
  misc_feature 1..23: note = Synthetic
  source 1..23: mol_type = other RNA
caagagtctgtcttcgatgaccc

SEQ ID NO: 1108 - RNA, 23 nt, synthetic construct
  misc_feature 1..23: note = Synthetic
  source 1..23: mol_type = other RNA
ccagatgccagtgcaagggtcct

SEQ ID NO: 1109 - RNA, 23 nt, synthetic construct
  misc_feature 1..23: note = Synthetic
  source 1..23: mol_type = other RNA
ccagcacgacctggctctgttgc

SEQ ID NO: 1110 - RNA, 23 nt, synthetic construct
  misc_feature 1..23: note = Synthetic
  source 1..23: mol_type = other RNA
caagccaggcgtctacaccgatg

SEQ ID NO: 1111 - RNA, 23 nt, synthetic construct
  misc_feature 1..23: note = Synthetic
  source 1..23: mol_type = other RNA
caagccaggcgtctacaccgatg

SEQ ID NO: 1112 - RNA, 23 nt, synthetic construct
  misc_feature 1..23: note = Synthetic
  source 1..23: mol_type = other RNA
ggagcccaagaaagtgaaagacc

SEQ ID NO: 1113 - RNA, 23 nt, synthetic construct
  misc_feature 1..23: note = Synthetic
  source 1..23: mol_type = other RNA
aaagctgaagagcacacagtcgt

SEQ ID NO: 1114 - RNA, 23 nt, synthetic construct
  misc_feature 1..23: note = Synthetic
  source 1..23: mol_type = other RNA
caagctgctatgatggccgcggg

SEQ ID NO: 1115 - RNA, 23 nt, synthetic construct
  misc_feature 1..23: note = Synthetic
  source 1..23: mol_type = other RNA
gcagctgtaccacaaatgtaccc

SEQ ID NO: 1116 - RNA, 23 nt, synthetic construct
  misc_feature 1..23: note = Synthetic
  source 1..23: mol_type = other RNA
caaggagcataagtacaaagctg

SEQ ID NO: 1117 - RNA, 23 nt, synthetic construct
  misc_feature 1..23: note = Synthetic
  source 1..23: mol_type = other RNA
caaggagcataagtacaaagctg

SEQ ID NO: 1118 - RNA, 23 nt, synthetic construct
  misc_feature 1..23: note = Synthetic
  source 1..23: mol_type = other RNA
ccaggatggcgcaggaactcaat

SEQ ID NO: 1119 - RNA, 23 nt, synthetic construct
  misc_feature 1..23: note = Synthetic
  source 1..23: mol_type = other RNA
ccaggcgtctacaccgatgtggc

SEQ ID NO: 1120 - RNA, 23 nt, synthetic construct
  misc_feature 1..23: note = Synthetic
  source 1..23: mol_type = other RNA
ctaggcttcatgtcccactcatg

SEQ ID NO: 1121 - RNA, 23 nt, synthetic construct
  misc_feature 1..23: note = Synthetic
  source 1..23: mol_type = other RNA
ggagtcaacactttcgattccac

SEQ ID NO: 1122 - RNA, 23 nt, synthetic construct
  misc_feature 1..23: note = Synthetic
  source 1..23: mol_type = other RNA
ggagtcaacactttcgattccac

SEQ ID NO: 1123 - RNA, 23 nt, synthetic construct
  misc_feature 1..23: note = Synthetic
  source 1..23: mol_type = other RNA
caataaagtgctttgaaaatgct

SEQ ID NO: 1124 - RNA, 23 nt, synthetic construct
  misc_feature 1..23: note = Synthetic
  source 1..23: mol_type = other RNA
acatccgcccgtggtgcttcgtg

SEQ ID NO: 1125 - RNA, 23 nt, synthetic construct
  misc_feature 1..23: note = Synthetic
  source 1..23: mol_type = other RNA
ggatcgggctgtggtgaccgcaa

SEQ ID NO: 1126 - RNA, 23 nt, synthetic construct
  misc_feature 1..23: note = Synthetic
  source 1..23: mol_type = other RNA
agatgccagtgcaagggtcctga

SEQ ID NO: 1127 - RNA, 23 nt, synthetic construct
  misc_feature 1..23: note = Synthetic
  source 1..23: mol_type = other RNA
gcatgctctgcgcagggttcctc

SEQ ID NO: 1128 - RNA, 23 nt, synthetic construct
  misc_feature 1..23: note = Synthetic
  source 1..23: mol_type = other RNA
aaatgtacccacaagggccggcc

SEQ ID NO: 1129 - RNA, 23 nt, synthetic construct
  misc_feature 1..23: note = Synthetic
  source 1..23: mol_type = other RNA
tgattgctcagggactcatcttt

SEQ ID NO: 1130 - RNA, 23 nt, synthetic construct
  misc_feature 1..23: note = Synthetic
  source 1..23: mol_type = other RNA
tacaaagctgaagagcacacagt

SEQ ID NO: 1131 - RNA, 23 nt, synthetic construct
  misc_feature 1..23: note = Synthetic
  source 1..23: mol_type = other RNA
cacaaatgtacccacaagggccg

SEQ ID NO: 1132 - RNA, 23 nt, synthetic construct
  misc_feature 1..23: note = Synthetic
  source 1..23: mol_type = other RNA
cccaagaaagtgaaagaccactg

SEQ ID NO: 1133 - RNA, 23 nt, synthetic construct
  misc_feature 1..23: note = Synthetic
  source 1..23: mol_type = other RNA
cgcaagagtctgtcttcgatgac

SEQ ID NO: 1134 - RNA, 23 nt, synthetic construct
  misc_feature 1..23: note = Synthetic
  source 1..23: mol_type = other RNA
cccaaggagcataagtacaaagc

SEQ ID NO: 1135 - RNA, 23 nt, synthetic construct
  misc_feature 1..23: note = Synthetic
  source 1..23: mol_type = other RNA
accacaaatgtacccacaagggc

SEQ ID NO: 1136 - RNA, 23 nt, synthetic construct
  misc_feature 1..23: note = Synthetic
  source 1..23: mol_type = other RNA
ctcaccctgcaaggcatcatcag

SEQ ID NO: 1137 - RNA, 23 nt, synthetic construct
  misc_feature 1..23: note = Synthetic
  source 1..23: mol_type = other RNA
tacaccgatgtggcctactacct

SEQ ID NO: 1138 - RNA, 23 nt, synthetic construct
  misc_feature 1..23: note = Synthetic
  source 1..23: mol_type = other RNA
agcacgacctggctctgttgcgc

SEQ ID NO: 1139 - RNA, 23 nt, synthetic construct
  misc_feature 1..23: note = Synthetic
  source 1..23: mol_type = other RNA
cccactgtctctgtccacaacac

SEQ ID NO: 1140 - RNA, 23 nt, synthetic construct
  misc_feature 1..23: note = Synthetic
  source 1..23: mol_type = other RNA
aacactttcgattccaccttggg

SEQ ID NO: 1141 - RNA, 23 nt, synthetic construct
  misc_feature 1..23: note = Synthetic
  source 1..23: mol_type = other RNA
gccagatgccagtgcaagggtcc

SEQ ID NO: 1142 - RNA, 23 nt, synthetic construct
  misc_feature 1..23: note = Synthetic
  source 1..23: mol_type = other RNA
accagcacgacctggctctgttg

SEQ ID NO: 1143 - RNA, 23 nt, synthetic construct
  misc_feature 1..23: note = Synthetic
  source 1..23: mol_type = other RNA
ggcagctgtaccacaaatgtacc

SEQ ID NO: 1144 - RNA, 23 nt, synthetic construct
  misc_feature 1..23: note = Synthetic
  source 1..23: mol_type = other RNA
agcagctgtggccagatgccagt

SEQ ID NO: 1145 - RNA, 23 nt, synthetic construct
  misc_feature 1..23: note = Synthetic
  source 1..23: mol_type = other RNA
cgcaggaactcaataaagtgctt

SEQ ID NO: 1146 - RNA, 23 nt, synthetic construct
  misc_feature 1..23: note = Synthetic
  source 1..23: mol_type = other RNA
gccaggatggcgcaggaactcaa

SEQ ID NO: 1147 - RNA, 23 nt, synthetic construct
  misc_feature 1..23: note = Synthetic
  source 1..23: mol_type = other RNA
gccaggcgtctacaccgatgtgg

SEQ ID NO: 1148 - RNA, 23 nt, synthetic construct
  misc_feature 1..23: note = Synthetic
  source 1..23: mol_type = other RNA
ctcagggactcatctttccctcc

SEQ ID NO: 1149 - RNA, 23 nt, synthetic construct
  misc_feature 1..23: note = Synthetic
  source 1..23: mol_type = other RNA
gccagtgcaagggtcctgatgcc

SEQ ID NO: 1150 - RNA, 23 nt, synthetic construct
  misc_feature 1..23: note = Synthetic
  source 1..23: mol_type = other RNA
taccacaaatgtacccacaaggg

SEQ ID NO: 1151 - RNA, 23 nt, synthetic construct
  misc_feature 1..23: note = Synthetic
  source 1..23: mol_type = other RNA
taccacaaatgtacccacaaggg

SEQ ID NO: 1152 - RNA, 23 nt, synthetic construct
  misc_feature 1..23: note = Synthetic
  source 1..23: mol_type = other RNA
ggccagatgccagtgcaagggtc

SEQ ID NO: 1153 - RNA, 23 nt, synthetic construct
  misc_feature 1..23: note = Synthetic
  source 1..23: mol_type = other RNA
agccaggcgtctacaccgatgtg

SEQ ID NO: 1154 - RNA, 23 nt, synthetic construct
  misc_feature 1..23: note = Synthetic
  source 1..23: mol_type = other RNA
agcccaagaaagtgaaagaccac

SEQ ID NO: 1155 - RNA, 23 nt, synthetic construct
  misc_feature 1..23: note = Synthetic
  source 1..23: mol_type = other RNA
aacccggacaacgacatccgccc

SEQ ID NO: 1156 - RNA, 23 nt, synthetic construct
  misc_feature 1..23: note = Synthetic
  source 1..23: mol_type = other RNA
aacccggacaacgacatccgccc

SEQ ID NO: 1157 - RNA, 23 nt, synthetic construct
  misc_feature 1..23: note = Synthetic
  source 1..23: mol_type = other RNA
caccctgcaaggcatcatcagct

SEQ ID NO: 1158 - RNA, 23 nt, synthetic construct
  misc_feature 1..23: note = Synthetic
  source 1..23: mol_type = other RNA
caccgatgtggcctactacctgg

SEQ ID NO: 1159 - RNA, 23 nt, synthetic construct
  misc_feature 1..23: note = Synthetic
  source 1..23: mol_type = other RNA
gaccgcaacaagccaggcgtcta

SEQ ID NO: 1160 - RNA, 23 nt, synthetic construct
  misc_feature 1..23: note = Synthetic
  source 1..23: mol_type = other RNA
ctccgcaagagtctgtcttcgat

SEQ ID NO: 1161 - RNA, 23 nt, synthetic construct
  misc_feature 1..23: note = Synthetic
  source 1..23: mol_type = other RNA
tgccggaacccggacaacgacat

SEQ ID NO: 1162 - RNA, 23 nt, synthetic construct
  misc_feature 1..23: note = Synthetic
  source 1..23: mol_type = other RNA
tgccggaacccggacaacgacat

SEQ ID NO: 1163 - RNA, 23 nt, synthetic construct
  misc_feature 1..23: note = Synthetic
  source 1..23: mol_type = other RNA
ttcctgcaggaggcgcaggtacc

SEQ ID NO: 1164 - RNA, 23 nt, synthetic construct
  misc_feature 1..23: note = Synthetic
  source 1..23: mol_type = other RNA
ctcctgtcgccttacgttcagcc

SEQ ID NO: 1165 - RNA, 23 nt, synthetic construct
  misc_feature 1..23: note = Synthetic
  source 1..23: mol_type = other RNA
ctcctgtcgccttacgttcagcc

SEQ ID NO: 1166 - RNA, 23 nt, synthetic construct
  misc_feature 1..23: note = Synthetic
  source 1..23: mol_type = other RNA
cgccttacgttcagccggtgtgc

SEQ ID NO: 1167 - RNA, 23 nt, synthetic construct
  misc_feature 1..23: note = Synthetic
  source 1..23: mol_type = other RNA
accgcaacaagccaggcgtctac

SEQ ID NO: 1168 - RNA, 23 nt, synthetic construct
  misc_feature 1..23: note = Synthetic
  source 1..23: mol_type = other RNA
ggcgcaggaactcaataaagtgc

SEQ ID NO: 1169 - RNA, 23 nt, synthetic construct
  misc_feature 1..23: note = Synthetic
  source 1..23: mol_type = other RNA
gtcgccttacgttcagccggtgt

SEQ ID NO: 1170 - RNA, 23 nt, synthetic construct
  misc_feature 1..23: note = Synthetic
  source 1..23: mol_type = other RNA
cgcgctcctgtcgccttacgttc

SEQ ID NO: 1171 - RNA, 23 nt, synthetic construct
  misc_feature 1..23: note = Synthetic
  source 1..23: mol_type = other RNA
gccggaacccggacaacgacatc

SEQ ID NO: 1172 - RNA, 23 nt, synthetic construct
  misc_feature 1..23: note = Synthetic
  source 1..23: mol_type = other RNA
agcggctccgcaagagtctgtct

SEQ ID NO: 1173 - RNA, 23 nt, synthetic construct
  misc_feature 1..23: note = Synthetic
  source 1..23: mol_type = other RNA
ggcgtctacaccgatgtggccta

SEQ ID NO: 1174 - RNA, 23 nt, synthetic construct
  misc_feature 1..23: note = Synthetic
  source 1..23: mol_type = other RNA
tgcgtgccagggtgattccggag

SEQ ID NO: 1175 - RNA, 23 nt, synthetic construct
  misc_feature 1..23: note = Synthetic
  source 1..23: mol_type = other RNA
ccctacatcgccgcgctgtactg

SEQ ID NO: 1176 - RNA, 23 nt, synthetic construct
  misc_feature 1..23: note = Synthetic
  source 1..23: mol_type = other RNA
tactacctggcctggatccggga

SEQ ID NO: 1177 - RNA, 23 nt, synthetic construct
  misc_feature 1..23: note = Synthetic
  source 1..23: mol_type = other RNA
aactcaataaagtgctttgaaaa

SEQ ID NO: 1178 - RNA, 23 nt, synthetic construct
  misc_feature 1..23: note = Synthetic
  source 1..23: mol_type = other RNA
aactcaataaagtgctttgaaaa

SEQ ID NO: 1179 - RNA, 23 nt, synthetic construct
  misc_feature 1..23: note = Synthetic
  source 1..23: mol_type = other RNA
tgctcagggactcatctttccct

SEQ ID NO: 1180 - RNA, 23 nt, synthetic construct
  misc_feature 1..23: note = Synthetic
  source 1..23: mol_type = other RNA
cgctcctgtcgccttacgttcag

SEQ ID NO: 1181 - RNA, 23 nt, synthetic construct
  misc_feature 1..23: note = Synthetic
  source 1..23: mol_type = other RNA
ggctctgttgcgccttcaggagg

SEQ ID NO: 1182 - RNA, 23 nt, synthetic construct
  misc_feature 1..23: note = Synthetic
  source 1..23: mol_type = other RNA
agctgaagagcacacagtcgttc

SEQ ID NO: 1183 - RNA, 23 nt, synthetic construct
  misc_feature 1..23: note = Synthetic
  source 1..23: mol_type = other RNA
tcctgattgctcagggactcatc

SEQ ID NO: 1184 - RNA, 23 nt, synthetic construct
  misc_feature 1..23: note = Synthetic
  source 1..23: mol_type = other RNA
ccctgcaaggcatcatcagctgg

SEQ ID NO: 1185 - RNA, 23 nt, synthetic construct
  misc_feature 1..23: note = Synthetic
  source 1..23: mol_type = other RNA
ttctgccggaacccggacaacga

SEQ ID NO: 1186 - RNA, 23 nt, synthetic construct
  misc_feature 1..23: note = Synthetic
  source 1..23: mol_type = other RNA
agctgtaccacaaatgtacccac

SEQ ID NO: 1187 - RNA, 23 nt, synthetic construct
  misc_feature 1..23: note = Synthetic
  source 1..23: mol_type = other RNA
tcctgtcgccttacgttcagccg

SEQ ID NO: 1188 - RNA, 23 nt, synthetic construct
  misc_feature 1..23: note = Synthetic
  source 1..23: mol_type = other RNA
cactgtctctgtccacaacacct

SEQ ID NO: 1189 - RNA, 23 nt, synthetic construct
  misc_feature 1..23: note = Synthetic
  source 1..23: mol_type = other RNA
ggctgtggtgaccgcaacaagcc

SEQ ID NO: 1190 - RNA, 23 nt, synthetic construct
  misc_feature 1..23: note = Synthetic
  source 1..23: mol_type = other RNA
gccttacgttcagccggtgtgcc

SEQ ID NO: 1191 - RNA, 23 nt, synthetic construct
  misc_feature 1..23: note = Synthetic
  source 1..23: mol_type = other RNA
gtcttcgatgacccgcgtcgttg

SEQ ID NO: 1192 - RNA, 23 nt, synthetic construct
  misc_feature 1..23: note = Synthetic
  source 1..23: mol_type = other RNA
agcttggagtcaacactttcgat

SEQ ID NO: 1193 - RNA, 23 nt, synthetic construct
  misc_feature 1..23: note = Synthetic
  source 1..23: mol_type = other RNA
tgctttgagcctcagcttctccg

SEQ ID NO: 1194 - RNA, 23 nt, synthetic construct
  misc_feature 1..23: note = Synthetic
  source 1..23: mol_type = other RNA
aagaaagtgaaagaccactgcag

SEQ ID NO: 1195 - RNA, 23 nt, synthetic construct
  misc_feature 1..23: note = Synthetic
  source 1..23: mol_type = other RNA
cggaacccggacaacgacatccg

SEQ ID NO: 1196 - RNA, 23 nt, synthetic construct
  misc_feature 1..23: note = Synthetic
  source 1..23: mol_type = other RNA
aggaactcaataaagtgctttga

SEQ ID NO: 1197 - RNA, 23 nt, synthetic construct
  misc_feature 1..23: note = Synthetic
  source 1..23: mol_type = other RNA
ctgaagagcacacagtcgttctc

SEQ ID NO: 1198 - RNA, 23 nt, synthetic construct
  misc_feature 1..23: note = Synthetic
  source 1..23: mol_type = other RNA
gtgaccgcaacaagccaggcgtc

SEQ ID NO: 1199 - RNA, 23 nt, synthetic construct
  misc_feature 1..23: note = Synthetic
  source 1..23: mol_type = other RNA
aagagcacacagtcgttctcact

SEQ ID NO: 1200 - RNA, 23 nt, synthetic construct
  misc_feature 1..23: note = Synthetic
  source 1..23: mol_type = other RNA
aggagcataagtacaaagctgaa

SEQ ID NO: 1201 - RNA, 23 nt, synthetic construct
  misc_feature 1..23: note = Synthetic
  source 1..23: mol_type = other RNA
ttgagcctcagcttctccggttt

SEQ ID NO: 1202 - RNA, 23 nt, synthetic construct
  misc_feature 1..23: note = Synthetic
  source 1..23: mol_type = other RNA
aagagtctgtcttcgatgacccg

SEQ ID NO: 1203 - RNA, 23 nt, synthetic construct
  misc_feature 1..23: note = Synthetic
  source 1..23: mol_type = other RNA
cagatgccagtgcaagggtcctg

SEQ ID NO: 1204 - RNA, 23 nt, synthetic construct
  misc_feature 1..23: note = Synthetic
  source 1..23: mol_type = other RNA
aggatggcgcaggaactcaataa

SEQ ID NO: 1205 - RNA, 23 nt, synthetic construct
  misc_feature 1..23: note = Synthetic
  source 1..23: mol_type = other RNA
ctgattgctcagggactcatctt

SEQ ID NO: 1206 - RNA, 23 nt, synthetic construct
  misc_feature 1..23: note = Synthetic
  source 1..23: mol_type = other RNA
ccgcaagagtctgtcttcgatga

SEQ ID NO: 1207 - RNA, 23 nt, synthetic construct
  misc_feature 1..23: note = Synthetic
  source 1..23: mol_type = other RNA
gagcacacagtcgttctcactgt

SEQ ID NO: 1208 - RNA, 23 nt, synthetic construct
  misc_feature 1..23: note = Synthetic
  source 1..23: mol_type = other RNA
cagcacgacctggctctgttgcg

SEQ ID NO: 1209 - RNA, 23 nt, synthetic construct
  misc_feature 1..23: note = Synthetic
  source 1..23: mol_type = other RNA
cagcacgacctggctctgttgcg

SEQ ID NO: 1210 - RNA, 23 nt, synthetic construct
  misc_feature 1..23: note = Synthetic
  source 1..23: mol_type = other RNA
aagcagctgtggccagatgccag

SEQ ID NO: 1211 - RNA, 23 nt, synthetic construct
  misc_feature 1..23: note = Synthetic
  source 1..23: mol_type = other RNA
gcgcaggaactcaataaagtgct

SEQ ID NO: 1212 - RNA, 23 nt, synthetic construct
  misc_feature 1..23: note = Synthetic
  source 1..23: mol_type = other RNA
tggccagatgccagtgcaagggt

SEQ ID NO: 1213 - RNA, 23 nt, synthetic construct
  misc_feature 1..23: note = Synthetic
  source 1..23: mol_type = other RNA
aagccaggcgtctacaccgatgt

SEQ ID NO: 1214 - RNA, 23 nt, synthetic construct
  misc_feature 1..23: note = Synthetic
  source 1..23: mol_type = other RNA
gagcccaagaaagtgaaagacca

SEQ ID NO: 1215 - RNA, 23 nt, synthetic construct
  misc_feature 1..23: note = Synthetic
  source 1..23: mol_type = other RNA
tcgccttacgttcagccggtgtg

SEQ ID NO: 1216 - RNA, 23 nt, synthetic construct
  misc_feature 1..23: note = Synthetic
  source 1..23: mol_type = other RNA
tggcgcaggaactcaataaagtg

SEQ ID NO: 1217 - RNA, 23 nt, synthetic construct
  misc_feature 1..23: note = Synthetic
  source 1..23: mol_type = other RNA
ttgcgccttcaggaggatgcgga

SEQ ID NO: 1218 - RNA, 23 nt, synthetic construct
  misc_feature 1..23: note = Synthetic
  source 1..23: mol_type = other RNA
cagcggctccgcaagagtctgtc

SEQ ID NO: 1219 - RNA, 23 nt, synthetic construct
  misc_feature 1..23: note = Synthetic
  source 1..23: mol_type = other RNA
ttgctcagggactcatctttccc

SEQ ID NO: 1220 - RNA, 23 nt, synthetic construct
  misc_feature 1..23: note = Synthetic
  source 1..23: mol_type = other RNA
cggctccgcaagagtctgtcttc

SEQ ID NO: 1221 - RNA, 23 nt, synthetic construct
  misc_feature 1..23: note = Synthetic
  source 1..23: mol_type = other RNA
gcgctcctgtcgccttacgttca

SEQ ID NO: 1222 - RNA, 23 nt, synthetic construct
  misc_feature 1..23: note = Synthetic
  source 1..23: mol_type = other RNA
atgctctgcgcagggttcctcga

SEQ ID NO: 1223 - RNA, 23 nt, synthetic construct
  misc_feature 1..23: note = Synthetic
  source 1..23: mol_type = other RNA
atgctctgcgcagggttcctcga

SEQ ID NO: 1224 - RNA, 23 nt, synthetic construct
  misc_feature 1..23: note = Synthetic
  source 1..23: mol_type = other RNA
tggctctgttgcgccttcaggag

SEQ ID NO: 1225 - RNA, 23 nt, synthetic construct
  misc_feature 1..23: note = Synthetic
  source 1..23: mol_type = other RNA
tggctctgttgcgccttcaggag

SEQ ID NO: 1226 - RNA, 23 nt, synthetic construct
  misc_feature 1..23: note = Synthetic
  source 1..23: mol_type = other RNA
aagctgaagagcacacagtcgtt

SEQ ID NO: 1227 - RNA, 23 nt, synthetic construct
  misc_feature 1..23: note = Synthetic
  source 1..23: mol_type = other RNA
aagctgctatgatggccgcgggc

SEQ ID NO: 1228 - RNA, 23 nt, synthetic construct
  misc_feature 1..23: note = Synthetic
  source 1..23: mol_type = other RNA
ccgctggtgtgtgaggaccaagc

SEQ ID NO: 1229 - RNA, 23 nt, synthetic construct
  misc_feature 1..23: note = Synthetic
  source 1..23: mol_type = other RNA
gggctgtggtgaccgcaacaagc

SEQ ID NO: 1230 - RNA, 23 nt, synthetic construct
  misc_feature 1..23: note = Synthetic
  source 1..23: mol_type = other RNA
gggctgtggtgaccgcaacaagc

SEQ ID NO: 1231 - RNA, 23 nt, synthetic construct
  misc_feature 1..23: note = Synthetic
  source 1..23: mol_type = other RNA
aggcttcatgtcccactcatgcc

SEQ ID NO: 1232 - RNA, 23 nt, synthetic construct
  misc_feature 1..23: note = Synthetic
  source 1..23: mol_type = other RNA
gtgctttgagcctcagcttctcc

SEQ ID NO: 1233 - RNA, 23 nt, synthetic construct
  misc_feature 1..23: note = Synthetic
  source 1..23: mol_type = other RNA
caggaactcaataaagtgctttg

SEQ ID NO: 1234 - RNA, 23 nt, synthetic construct
  misc_feature 1..23: note = Synthetic
  source 1..23: mol_type = other RNA
aaggagcataagtacaaagctga

SEQ ID NO: 1235 - RNA, 23 nt, synthetic construct
  misc_feature 1..23: note = Synthetic
  source 1..23: mol_type = other RNA
ttggagcccaagaaagtgaaaga

SEQ ID NO: 1236 - RNA, 23 nt, synthetic construct
  misc_feature 1..23: note = Synthetic
  source 1..23: mol_type = other RNA
ttggagtcaacactttcgattcc

SEQ ID NO: 1237 - RNA, 23 nt, synthetic construct
  misc_feature 1..23: note = Synthetic
  source 1..23: mol_type = other RNA
caggcgtctacaccgatgtggcc

SEQ ID NO: 1238 - RNA, 23 nt, synthetic construct
  misc_feature 1..23: note = Synthetic
  source 1..23: mol_type = other RNA
caggcgtctacaccgatgtggcc

SEQ ID NO: 1239 - RNA, 23 nt, synthetic construct
  misc_feature 1..23: note = Synthetic
  source 1..23: mol_type = other RNA
gcggctccgcaagagtctgtctt

SEQ ID NO: 1240 - RNA, 23 nt, synthetic construct
  misc_feature 1..23: note = Synthetic
  source 1..23: mol_type = other RNA
ctggctctgttgcgccttcagga

SEQ ID NO: 1241 - RNA, 23 nt, synthetic construct
  misc_feature 1..23: note = Synthetic
  source 1..23: mol_type = other RNA
aagggtcctgatgcccactgcca

SEQ ID NO: 1242 - RNA, 23 nt, synthetic construct
  misc_feature 1..23: note = Synthetic
  source 1..23: mol_type = other RNA
gagtcaacactttcgattccacc

SEQ ID NO: 1243 - RNA, 23 nt, synthetic construct
  misc_feature 1..23: note = Synthetic
  source 1..23: mol_type = other RNA
gagtcaacactttcgattccacc

SEQ ID NO: 1244 - RNA, 23 nt, synthetic construct
  misc_feature 1..23: note = Synthetic
  source 1..23: mol_type = other RNA
ctgtcgccttacgttcagccggt

SEQ ID NO: 1245 - RNA, 23 nt, synthetic construct
  misc_feature 1..23: note = Synthetic
  source 1..23: mol_type = other RNA
ctgtcgccttacgttcagccggt

SEQ ID NO: 1246 - RNA, 23 nt, synthetic construct
  misc_feature 1..23: note = Synthetic
  source 1..23: mol_type = other RNA
cagtcgttctcactgtcaccggg

SEQ ID NO: 1247 - RNA, 23 nt, synthetic construct
  misc_feature 1..23: note = Synthetic
  source 1..23: mol_type = other RNA
gagtctgtcttcgatgacccgcg

SEQ ID NO: 1248 - RNA, 23 nt, synthetic construct
  misc_feature 1..23: note = Synthetic
  source 1..23: mol_type = other RNA
ctgtcttcgatgacccgcgtcgt

SEQ ID NO: 1249 - RNA, 23 nt, synthetic construct
  misc_feature 1..23: note = Synthetic
  source 1..23: mol_type = other RNA
cagtgcaagggtcctgatgccca

SEQ ID NO: 1250 - RNA, 23 nt, synthetic construct
  misc_feature 1..23: note = Synthetic
  source 1..23: mol_type = other RNA
ctgtggtgaccgcaacaagccag

SEQ ID NO: 1251 - RNA, 23 nt, synthetic construct
  misc_feature 1..23: note = Synthetic
  source 1..23: mol_type = other RNA
ctgttgcgccttcaggaggatgc

SEQ ID NO: 1252 - RNA, 23 nt, synthetic construct
  misc_feature 1..23: note = Synthetic
  source 1..23: mol_type = other RNA
ctgttgcgccttcaggaggatgc

SEQ ID NO: 1253 - RNA, 23 nt, synthetic construct
  misc_feature 1..23: note = Synthetic
  source 1..23: mol_type = other RNA
cataagtacaaagctgaagagca

SEQ ID NO: 1254 - RNA, 23 nt, synthetic construct
  misc_feature 1..23: note = Synthetic
  source 1..23: mol_type = other RNA
cataagtacaaagctgaagagca

SEQ ID NO: 1255 - RNA, 23 nt, synthetic construct
  misc_feature 1..23: note = Synthetic
  source 1..23: mol_type = other RNA
cctacatcgccgcgctgtactgg

SEQ ID NO: 1256 - RNA, 23 nt, synthetic construct
  misc_feature 1..23: note = Synthetic
  source 1..23: mol_type = other RNA
actacctggcctggatccgggag

SEQ ID NO: 1257 - RNA, 23 nt, synthetic construct
  misc_feature 1..23: note = Synthetic
  source 1..23: mol_type = other RNA
cctactacctggcctggatccgg

SEQ ID NO: 1258 - RNA, 23 nt, synthetic construct
  misc_feature 1..23: note = Synthetic
  source 1..23: mol_type = other RNA
agtcaacactttcgattccacct

SEQ ID NO: 1259 - RNA, 23 nt, synthetic construct
  misc_feature 1..23: note = Synthetic
  source 1..23: mol_type = other RNA
gctcaccctgcaaggcatcatca

SEQ ID NO: 1260 - RNA, 23 nt, synthetic construct
  misc_feature 1..23: note = Synthetic
  source 1..23: mol_type = other RNA
gttcagccggtgtgcctgccaag

SEQ ID NO: 1261 - RNA, 23 nt, synthetic construct
  misc_feature 1..23: note = Synthetic
  source 1..23: mol_type = other RNA
cttcaggaggatgcggacggcag

SEQ ID NO: 1262 - RNA, 23 nt, synthetic construct
  misc_feature 1..23: note = Synthetic
  source 1..23: mol_type = other RNA
gctcagggactcatctttccctc

SEQ ID NO: 1263 - RNA, 23 nt, synthetic construct
  misc_feature 1..23: note = Synthetic
  source 1..23: mol_type = other RNA
gctccgcaagagtctgtcttcga

SEQ ID NO: 1264 - RNA, 23 nt, synthetic construct
  misc_feature 1..23: note = Synthetic
  source 1..23: mol_type = other RNA
gctcctgtcgccttacgttcagc

SEQ ID NO: 1265 - RNA, 23 nt, synthetic construct
  misc_feature 1..23: note = Synthetic
  source 1..23: mol_type = other RNA
tgtcgccttacgttcagccggtg

SEQ ID NO: 1266 - RNA, 23 nt, synthetic construct
  misc_feature 1..23: note = Synthetic
  source 1..23: mol_type = other RNA
tgtctctgtccacaacacctcac

SEQ ID NO: 1267 - RNA, 23 nt, synthetic construct
  misc_feature 1..23: note = Synthetic
  source 1..23: mol_type = other RNA
gctctgttgcgccttcaggagga

SEQ ID NO: 1268 - RNA, 23 nt, synthetic construct
  misc_feature 1..23: note = Synthetic
  source 1..23: mol_type = other RNA
gctgaagagcacacagtcgttct

SEQ ID NO: 1269 - RNA, 23 nt, synthetic construct
  misc_feature 1..23: note = Synthetic
  source 1..23: mol_type = other RNA
tttgagcctcagcttctccggtt

SEQ ID NO: 1270 - RNA, 23 nt, synthetic construct
  misc_feature 1..23: note = Synthetic
  source 1..23: mol_type = other RNA
gctgagctgggagtactgcgacc

SEQ ID NO: 1271 - RNA, 23 nt, synthetic construct
  misc_feature 1..23: note = Synthetic
  source 1..23: mol_type = other RNA
tatgatggccgcgggctcagcta

SEQ ID NO: 1272 - RNA, 23 nt, synthetic construct
  misc_feature 1..23: note = Synthetic
  source 1..23: mol_type = other RNA
cctgcaaggcatcatcagctggg

SEQ ID NO: 1273 - RNA, 23 nt, synthetic construct
  misc_feature 1..23: note = Synthetic
  source 1..23: mol_type = other RNA
cctgcaaggcatcatcagctggg

SEQ ID NO: 1274 - RNA, 23 nt, synthetic construct
  misc_feature 1..23: note = Synthetic
  source 1..23: mol_type = other RNA
agtgcaagggtcctgatgcccac

SEQ ID NO: 1275 - RNA, 23 nt, synthetic construct
  misc_feature 1..23: note = Synthetic
  source 1..23: mol_type = other RNA
gatgccagtgcaagggtcctgat

SEQ ID NO: 1276 - RNA, 23 nt, synthetic construct
  misc_feature 1..23: note = Synthetic
  source 1..23: mol_type = other RNA
gatgccatgagggctctgctgct

SEQ ID NO: 1277 - RNA, 23 nt, synthetic construct
  misc_feature 1..23: note = Synthetic
  source 1..23: mol_type = other RNA
gttgcgccttcaggaggatgcgg

SEQ ID NO: 1278 - RNA, 23 nt, synthetic construct
  misc_feature 1..23: note = Synthetic
  source 1..23: mol_type = other RNA
attgctcagggactcatctttcc

SEQ ID NO: 1279 - RNA, 23 nt, synthetic construct
  misc_feature 1..23: note = Synthetic
  source 1..23: mol_type = other RNA
attgctcagggactcatctttcc

SEQ ID NO: 1280 - RNA, 23 nt, synthetic construct
  misc_feature 1..23: note = Synthetic
  source 1..23: mol_type = other RNA
cttggagtcaacactttcgattc

SEQ ID NO: 1281 - RNA, 23 nt, synthetic construct
  misc_feature 1..23: note = Synthetic
  source 1..23: mol_type = other RNA
tgtggccagatgccagtgcaagg

SEQ ID NO: 1282 - RNA, 23 nt, synthetic construct
  misc_feature 1..23: note = Synthetic
  source 1..23: mol_type = other RNA
tgtggcctactacctggcctgga

SEQ ID NO: 1283 - RNA, 23 nt, synthetic construct
  misc_feature 1..23: note = Synthetic
  source 1..23: mol_type = other RNA
cctggctctgttgcgccttcagg

SEQ ID NO: 1284 - RNA, 23 nt, synthetic construct
  misc_feature 1..23: note = Synthetic
  source 1..23: mol_type = other RNA
tgtggtgaccgcaacaagccagg

SEQ ID NO: 1285 - RNA, 23 nt, synthetic construct
  misc_feature 1..23: note = Synthetic
  source 1..23: mol_type = other RNA
gctgtaccacaaatgtacccaca

SEQ ID NO: 1286 - RNA, 23 nt, synthetic construct
  misc_feature 1..23: note = Synthetic
  source 1..23: mol_type = other RNA
actgtctctgtccacaacacctc

SEQ ID NO: 1287 - RNA, 23 nt, synthetic construct
  misc_feature 1..23: note = Synthetic
  source 1..23: mol_type = other RNA
gctgtggccagatgccagtgcaa

SEQ ID NO: 1288 - RNA, 23 nt, synthetic construct
  misc_feature 1..23: note = Synthetic
  source 1..23: mol_type = other RNA
ccttacgttcagccggtgtgcct

SEQ ID NO: 1289 - RNA, 23 nt, synthetic construct
  misc_feature 1..23: note = Synthetic
  source 1..23: mol_type = other RNA
gcttcatgtcccactcatgcccg

SEQ ID NO: 1290 - RNA, 23 nt, synthetic construct
  misc_feature 1..23: note = Synthetic
  source 1..23: mol_type = other RNA
tcttcgatgacccgcgtcgttgg

SEQ ID NO: 1291 - RNA, 23 nt, synthetic construct
  misc_feature 1..23: note = Synthetic
  source 1..23: mol_type = other RNA
ctttgagcctcagcttctccggt

SEQ ID NO: 1292 - RNA, 23 nt, synthetic construct
  misc_feature 1..23: note = Synthetic
  source 1..23: mol_type = other RNA
gtttggagcccaagaaagtgaaa

SEQ ID NO: 1293 - RNA, 23 nt, synthetic construct
  misc_feature 1..23: note = Synthetic
  source 1..23: mol_type = other RNA
gcttggagtcaacactttcgatt

SEQ ID NO: 1294 - RNA, 23 nt, synthetic construct
  misc_feature 1..23: note = Synthetic
  source 1..23: mol_type = other RNA
gctttgagcctcagcttctccgg

SEQ ID NO: 1295 - RNA, 23 nt, synthetic construct
  misc_feature 1..23: note = Synthetic
  source 1..23: mol_type = other RNA
tgaagagcacacagtcgttctca

SEQ ID NO: 1296 - RNA, 23 nt, synthetic construct
  misc_feature 1..23: note = Synthetic
  source 1..23: mol_type = other RNA
tcaataaagtgctttgaaaatgc

SEQ ID NO: 1297 - RNA, 23 nt, synthetic construct
  misc_feature 1..23: note = Synthetic
  source 1..23: mol_type = other RNA
ctacatcgccgcgctgtactggg

SEQ ID NO: 1298 - RNA, 23 nt, synthetic construct
  misc_feature 1..23: note = Synthetic
  source 1..23: mol_type = other RNA
ctaccagcacgacctggctctgt

SEQ ID NO: 1299 - RNA, 23 nt, synthetic construct
  misc_feature 1..23: note = Synthetic
  source 1..23: mol_type = other RNA
tcaccctgcaaggcatcatcagc

SEQ ID NO: 1300 - RNA, 23 nt, synthetic construct
  misc_feature 1..23: note = Synthetic
  source 1..23: mol_type = other RNA
tgaccgcaacaagccaggcgtct

SEQ ID NO: 1301 - RNA, 23 nt, synthetic construct
  misc_feature 1..23: note = Synthetic
  source 1..23: mol_type = other RNA
ctactacctggcctggatccggg

SEQ ID NO: 1302 - RNA, 23 nt, synthetic construct
  misc_feature 1..23: note = Synthetic
  source 1..23: mol_type = other RNA
tgattgctcagggactcatcttt

SEQ ID NO: 1303 - RNA, 23 nt, synthetic construct
  misc_feature 1..23: note = Synthetic
  source 1..23: mol_type = other RNA
ctcagggactcatctttccctcc

SEQ ID NO: 1304 - RNA, 23 nt, synthetic construct
  misc_feature 1..23: note = Synthetic
  source 1..23: mol_type = other RNA
taccacaaatgtacccacaaggg

SEQ ID NO: 1305 - RNA, 23 nt, synthetic construct
  misc_feature 1..23: note = Synthetic
  source 1..23: mol_type = other RNA
ctccgcaagagtctgtcttcgat

SEQ ID NO: 1306 - RNA, 23 nt, synthetic construct
  misc_feature 1..23: note = Synthetic
  source 1..23: mol_type = other RNA
tgccggaacccggacaacgacat

SEQ ID NO: 1307 - RNA, 23 nt, synthetic construct
  misc_feature 1..23: note = Synthetic
  source 1..23: mol_type = other RNA
ctcctgtcgccttacgttcagcc

SEQ ID NO: 1308 - RNA, 23 nt, synthetic construct
  misc_feature 1..23: note = Synthetic
  source 1..23: mol_type = other RNA
gtcgccttacgttcagccggtgt

SEQ ID NO: 1309 - RNA, 23 nt, synthetic construct
  misc_feature 1..23: note = Synthetic
  source 1..23: mol_type = other RNA
tgcgtgccagggtgattccggag

SEQ ID NO: 1310 - RNA, 23 nt, synthetic construct
  misc_feature 1..23: note = Synthetic
  source 1..23: mol_type = other RNA
tactacctggcctggatccggga

SEQ ID NO: 1311 - RNA, 23 nt, synthetic construct
  misc_feature 1..23: note = Synthetic
  source 1..23: mol_type = other RNA
tgctcagggactcatctttccct

SEQ ID NO: 1312 - RNA, 23 nt, synthetic construct
  misc_feature 1..23: note = Synthetic
  source 1..23: mol_type = other RNA
gtcttcgatgacccgcgtcgttg

SEQ ID NO: 1313 - RNA, 23 nt, synthetic construct
  misc_feature 1..23: note = Synthetic
  source 1..23: mol_type = other RNA
ctgaagagcacacagtcgttctc

SEQ ID NO: 1314 - RNA, 23 nt, synthetic construct
  misc_feature 1..23: note = Synthetic
  source 1..23: mol_type = other RNA
ttgagcctcagcttctccggttt

SEQ ID NO: 1315 - RNA, 23 nt, synthetic construct
  misc_feature 1..23: note = Synthetic
  source 1..23: mol_type = other RNA
tggccagatgccagtgcaagggt

SEQ ID NO: 1316 - RNA, 23 nt, synthetic construct
  misc_feature 1..23: note = Synthetic
  source 1..23: mol_type = other RNA
tcgccttacgttcagccggtgtg

SEQ ID NO: 1317 - RNA, 23 nt, synthetic construct
  misc_feature 1..23: note = Synthetic
  source 1..23: mol_type = other RNA
tggcgcaggaactcaataaagtg

SEQ ID NO: 1318 - RNA, 23 nt, synthetic construct
  misc_feature 1..23: note = Synthetic
  source 1..23: mol_type = other RNA
ttgcgccttcaggaggatgcgga

SEQ ID NO: 1319 - RNA, 23 nt, synthetic construct
  misc_feature 1..23: note = Synthetic
  source 1..23: mol_type = other RNA
ttgctcagggactcatctttccc

SEQ ID NO: 1320 - RNA, 23 nt, synthetic construct
  misc_feature 1..23: note = Synthetic
  source 1..23: mol_type = other RNA
atgctctgcgcagggttcctcga

SEQ ID NO: 1321 - RNA, 23 nt, synthetic construct
  misc_feature 1..23: note = Synthetic
  source 1..23: mol_type = other RNA
tggctctgttgcgccttcaggag

SEQ ID NO: 1322 - RNA, 23 nt, synthetic construct
  misc_feature 1..23: note = Synthetic
  source 1..23: mol_type = other RNA
gtgctttgagcctcagcttctcc

SEQ ID NO: 1323 - RNA, 23 nt, synthetic construct
  misc_feature 1..23: note = Synthetic
  source 1..23: mol_type = other RNA
ttggagtcaacactttcgattcc

SEQ ID NO: 1324 - RNA, 23 nt, synthetic construct
  misc_feature 1..23: note = Synthetic
  source 1..23: mol_type = other RNA
ctggctctgttgcgccttcagga

SEQ ID NO: 1325 - RNA, 23 nt, synthetic construct
  misc_feature 1..23: note = Synthetic
  source 1..23: mol_type = other RNA
ctgtcgccttacgttcagccggt

SEQ ID NO: 1326 - RNA, 23 nt, synthetic construct
  misc_feature 1..23: note = Synthetic
  source 1..23: mol_type = other RNA
ctgtcttcgatgacccgcgtcgt

SEQ ID NO: 1327 - RNA, 23 nt, synthetic construct
  misc_feature 1..23: note = Synthetic
  source 1..23: mol_type = other RNA
ctgttgcgccttcaggaggatgc

SEQ ID NO: 1328 - RNA, 23 nt, synthetic construct
  misc_feature 1..23: note = Synthetic
  source 1..23: mol_type = other RNA
tgtcgccttacgttcagccggtg

SEQ ID NO: 1329 - RNA, 23 nt, synthetic construct
  misc_feature 1..23: note = Synthetic
  source 1..23: mol_type = other RNA
tttgagcctcagcttctccggtt

SEQ ID NO: 1330 - RNA, 23 nt, synthetic construct
  misc_feature 1..23: note = Synthetic
  source 1..23: mol_type = other RNA
gttgcgccttcaggaggatgcgg

SEQ ID NO: 1331 - RNA, 23 nt, synthetic construct
  misc_feature 1..23: note = Synthetic
  source 1..23: mol_type = other RNA
attgctcagggactcatctttcc

SEQ ID NO: 1332 - RNA, 23 nt, synthetic construct
  misc_feature 1..23: note = Synthetic
  source 1..23: mol_type = other RNA
cttggagtcaacactttcgattc

SEQ ID NO: 1333 - RNA, 23 nt, synthetic construct
  misc_feature 1..23: note = Synthetic
  source 1..23: mol_type = other RNA
tgtggcctactacctggcctgga

SEQ ID NO: 1334 - RNA, 23 nt, synthetic construct
  misc_feature 1..23: note = Synthetic
  source 1..23: mol_type = other RNA
tcttcgatgacccgcgtcgttgg

SEQ ID NO: 1335 - RNA, 23 nt, synthetic construct
  misc_feature 1..23: note = Synthetic
  source 1..23: mol_type = other RNA
ctttgagcctcagcttctccggt

SEQ ID NO: 1336 - RNA, 23 nt, synthetic construct
  misc_feature 1..23: note = Synthetic
  source 1..23: mol_type = other RNA
gaactcaataaagtgctttgaaa

SEQ ID NO: 1337 - RNA, 23 nt, synthetic construct
  misc_feature 1..23: note = Synthetic
  source 1..23: mol_type = other RNA
actcaataaagtgctttgaaaat

SEQ ID NO: 1338 - RNA, 23 nt, synthetic construct
  misc_feature 1..23: note = Synthetic
  source 1..23: mol_type = other RNA
aactcaataaagtgctttgaaaa

SEQ ID NO: 1339 - RNA, 23 nt, synthetic construct
  misc_feature 1..23: note = Synthetic
  source 1..23: mol_type = other RNA
aggaactcaataaagtgctttga

SEQ ID NO: 1340 - RNA, 20 nt, synthetic construct
  misc_feature 1..20: note = Synthetic
  source 1..20: mol_type = other RNA
  modified_base 5: mod_base = OTHER; note = thymine
  modified_base 10: mod_base = OTHER; note = thymine
  modified_base 13..15: mod_base = OTHER; note = thymine
tcaataaagtgctttgaaaa

We claim:

1. A double stranded ribonucleic acid (dsRNA) agent for inhibiting expression of Factor XII (F12) in a cell, or a pharmaceutically acceptable salt thereof, comprising a sense strand and an antisense strand forming a double stranded region,
wherein the nucleotide sequence of the sense strand differs by no more than 4 bases from the nucleotide sequence 5'-gsasagagcaCfAfCfagucguucuu-3' of SEQ ID NO: 669 and the nucleotide sequence of the antisense strand differs by no more than 4 bases from the nucleotide sequence 5'-asdAsgadAcdGacugdTgUfgcucuucsasg-3' of SEQ ID NO: 933,
wherein a, g, c and u are 2'-O-methyl (2'-OMe) A, G, C, and U; Cf, Af, and Uf are 2'-fluoro (2'-F) C, A, and U; dA, dG, and dT are 2'-deoxy A, G, and T; and s is a phosphorothioate linkage.

2. The dsRNA agent, or a pharmaceutically acceptable salt thereof, of claim 1,
wherein the nucleotide sequence of the sense strand differs by no more than 3 bases from the nucleotide sequence 5'-gsasagagcaCfAfCfagucguucuu-3' of SEQ ID NO: 669 and the nucleotide sequence of the antisense strand differs by no more than 3 bases from the nucleotide sequence 5'-asdAsgadAcdGacugdTgUfgcucuucsasg-3' of SEQ ID NO: 933.

3. The dsRNA agent, or a pharmaceutically acceptable salt thereof, of claim 1,
wherein the nucleotide sequence of the sense strand differs by no more than 2 bases from the nucleotide sequence 5'-gsasagagcaCfAfCfagucguucuu-3' of SEQ ID NO: 669 and the nucleotide sequence of the antisense strand differs by no more than 2 bases from the nucleotide sequence 5'-asdAsgadAcdGacugdTgUfgcucuucsasg-3' of SEQ ID NO: 933.

4. The dsRNA agent, or a pharmaceutically acceptable salt thereof, of claim 1,
wherein the nucleotide sequence of the sense strand differs by no more than 1 base from the nucleotide sequence 5'-gsasagagcaCfAfCfagucguucuu-3' of SEQ ID NO: 669 and the nucleotide sequence of the antisense strand differs by no more than 1 base from the nucleotide sequence 5'-asdAsgadAcdGacugdTgUfgcucuucsasg-3' of SEQ ID NO: 933.

5. The dsRNA agent, or a pharmaceutically acceptable salt thereof, of claim 1,
wherein the nucleotide sequence of the sense strand comprises the nucleotide sequence 5'-gsasagagcaCfAfCfagucguucuu-3' of SEQ ID NO: 669 and the nucleotide sequence of the antisense strand comprises the nucleotide sequence 5'-asdAsgadAcdGacugdTgUfgcucuucsasg-3' of SEQ ID NO: 933.

6. The dsRNA agent, or a pharmaceutically acceptable salt thereof, of claim 1,
wherein the nucleotide sequence of the sense strand consists of the nucleotide sequence 5'-gsasagagcaCfAfCfagucguucuu-3' of SEQ ID NO: 669 and the nucleotide sequence of the antisense strand comprises the nucleotide sequence 5'-asdAsgadAcdGacugdTgUfgcucuucsasg-3' of SEQ ID NO: 933.

7. The dsRNA agent, or a pharmaceutically acceptable salt thereof, of claim 1, further comprising a ligand.

8. The dsRNA agent, or a pharmaceutically acceptable salt thereof, of claim 7, wherein the ligand is conjugated to the 3' end of the sense strand of the dsRNA agent.

9. The dsRNA agent, or a pharmaceutically acceptable salt thereof, of claim 7, wherein the ligand is an N-acetyl-galactosamine (GalNAc) derivative.

10. The dsRNA agent, or a pharmaceutically acceptable salt thereof, of claim 9, wherein the ligand is one or more GalNAc derivatives attached through a monovalent, bivalent, or trivalent branched linker.

11. The dsRNA agent, or a pharmaceutically acceptable salt thereof, of claim 9, wherein the ligand is

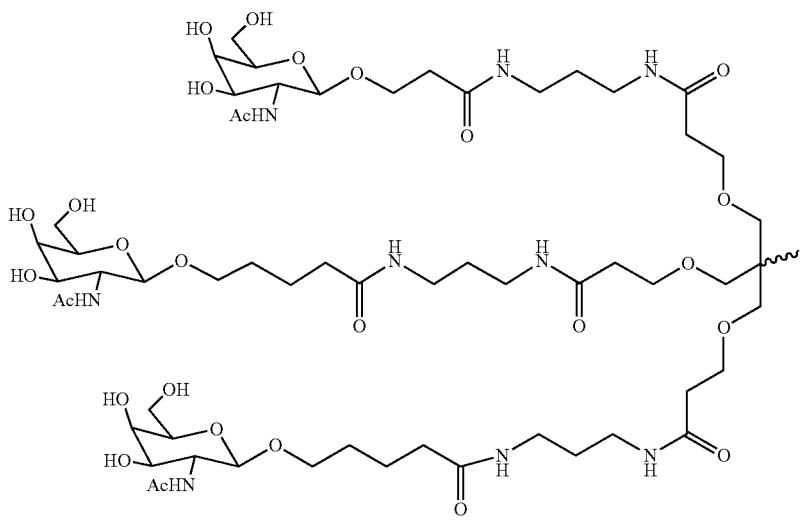 [SMILES: CC(=O)NC1C(OCCCCC(=O)NCCCNC(=O)CCOCC(C)(COCCC(=O)NCCCNC(=O)CCCCOC2OC(CO)C(O)C(O)C2NC(C)=O)COCCC(=O)NCCCNC(=O)CCOC2OC(CO)C(O)C(O)C2NC(C)=O)OC(CO)C(O)C1O]

12. The dsRNA agent, or a pharmaceutically acceptable salt thereof, of claim 11, wherein the dsRNA agent is conjugated to the ligand as shown in the following schematic

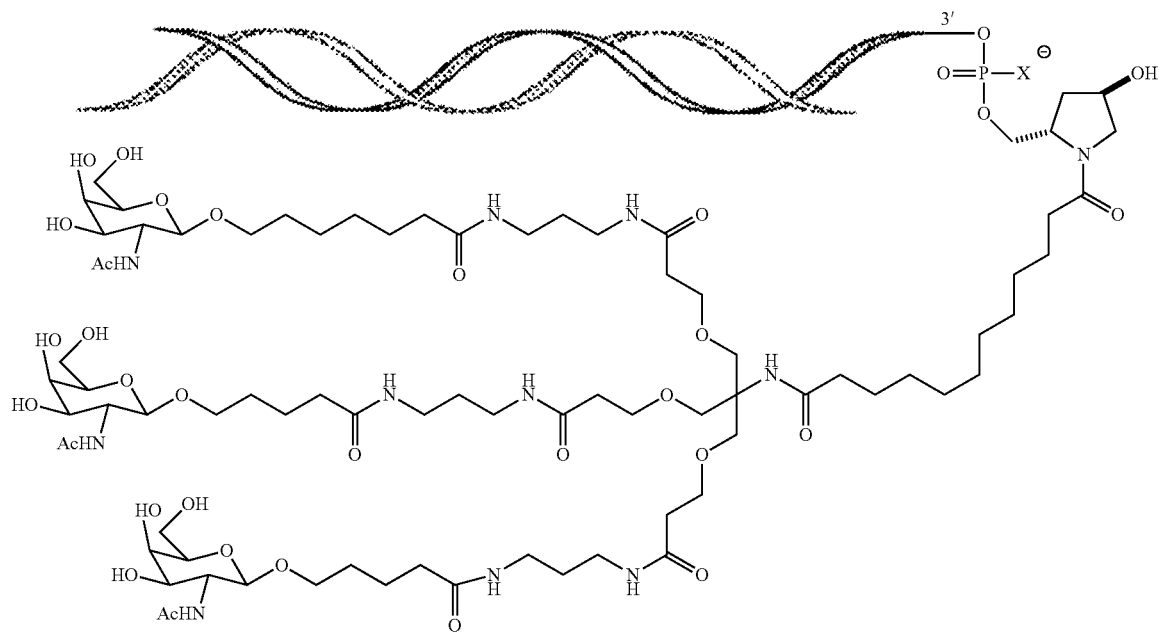

and, wherein X is O or S.

13. The dsRNA agent, or a pharmaceutically acceptable salt thereof, of claim 12, wherein X is O.

14. An isolated cell containing the dsRNA agent, or a pharmaceutically acceptable salt thereof, of claim 1.

15. A pharmaceutical composition for inhibiting expression of a gene encoding Factor XII (F12) comprising the dsRNA agent, or a pharmaceutically acceptable salt thereof, of claim 1.

16. A double stranded ribonucleic acid (dsRNA) agent for inhibiting expression of Factor XII (F12) in a cell, or a pharmaceutically acceptable salt thereof, comprising a sense strand and an antisense strand forming a double stranded region,
    wherein the sense strand comprises the nucleotide sequence 5'-gsasagagcaCfAfCfagucguucuu-3' of SEQ ID NO: 669 and the antisense strand comprises the nucleotide sequence 5'-asdAsgadAcdGacugdTgUfgcucuucsasg-3' of SEQ ID NO: 933,
    wherein a, g, c and u are 2'-O-methyl (2'-OMe) A, G, C, and U; Cf, Af, and Uf are 2'-fluoro (2'-F) C, A, and U; dA, dG, and dT are 2'-deoxy A, G, and T; and s is a phosphorothioate linkage.

17. The dsRNA agent, or a pharmaceutically acceptable salt thereof, of claim 16, further comprising a ligand.

18. An isolated cell containing the dsRNA agent, or a pharmaceutically acceptable salt thereof, of claim 16.

19. A pharmaceutical composition for inhibiting expression of a gene encoding Factor XII (F12) comprising the dsRNA agent, or pharmaceutically acceptable salt thereof, of claim 16.

20. A double stranded ribonucleic acid (dsRNA) agent for inhibiting expression of Factor XII (F12) in a cell, or a pharmaceutically acceptable salt thereof, comprising a sense strand and an antisense strand forming a double stranded region,
    wherein the sense strand comprises the nucleotide sequence 5'-gsasagagcaCfAfCfagucguucuu-3' of SEQ ID NO: 669 and the antisense strand comprises the nucleotide sequence 5'-asdAsgadAcdGacugdTgUfgcucuucsasg-3' of SEQ ID NO: 933,
    wherein a, g, c and u are 2'-O-methyl (2'-OMe) A, G, C, and U; Cf, Af, and Uf are 2'-fluoro (2'-F) C, A, and U; dA, dG, and dT are 2'-deoxy A, G, and T; and s is a phosphorothioate linkage, and
    wherein a ligand is conjugated to the 3'-end of the sense strand as shown in the following schematic

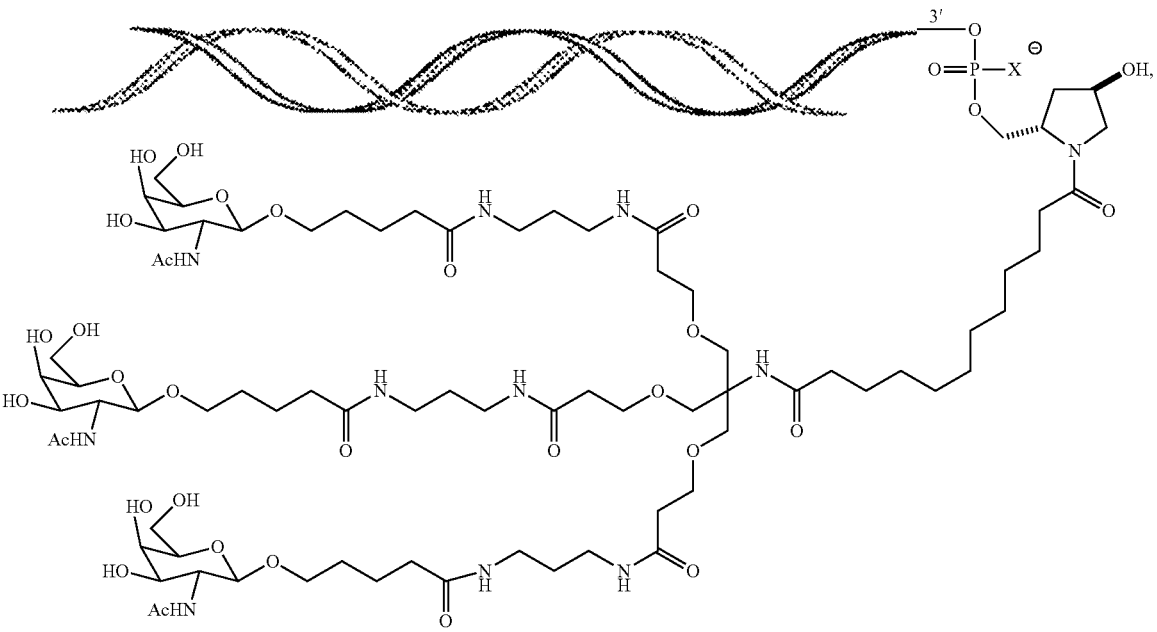

wherein X is O.

21. The dsRNA agent, or a pharmaceutically acceptable salt thereof, of claim 20, which is in a salt form.

22. An isolated cell containing the dsRNA agent, or a pharmaceutically acceptable salt thereof, of claim 20.

23. A pharmaceutical composition for inhibiting expression of a gene encoding Factor XII (F12) comprising the dsRNA agent, or a pharmaceutically acceptable salt thereof, of claim 20.

24. The pharmaceutical composition of claim 23, wherein the dsRNA agent, or a pharmaceutically acceptable salt thereof, is in an unbuffered solution.

25. The pharmaceutical composition of claim 24, wherein the unbuffered solution is saline or water.

26. The pharmaceutical composition of claim 23, wherein the dsRNA agent, or a pharmaceutically acceptable salt thereof, is in a buffer solution.

27. The pharmaceutical composition of claim 26, wherein the buffer solution comprises acetate, citrate, prolamine, carbonate, or phosphate or any combination thereof.

28. The pharmaceutical composition of claim 27, wherein the buffer solution is phosphate buffered saline (PBS).

29. A double stranded ribonucleic acid (dsRNA) agent for inhibiting expression of Factor XII (F12) in a cell, or a pharmaceutically acceptable salt thereof, comprising a sense strand and an antisense strand forming a double stranded region,
  wherein the sense strand consists of the nucleotide sequence 5'-gsasagagcaCfAfCfagucguucuu-3' of SEQ ID NO: 669 and the antisense strand consists of the nucleotide sequence 5'-asdAsgadAcdGacugdTgUfgcu-cuucsasg-3' of SEQ ID NO: 933,
  wherein a, g, c and u are 2'-O-methyl (2'-OMe) A, G, C, and U; Cf, Af, and Uf are 2'-fluoro (2'-F) C, A, and U; dA, dG, and dT are 2'-deoxy A, G, and T; and s is a phosphorothioate linkage, and
  wherein a ligand is conjugated to the 3'-end of the sense strand as shown in the following schematic

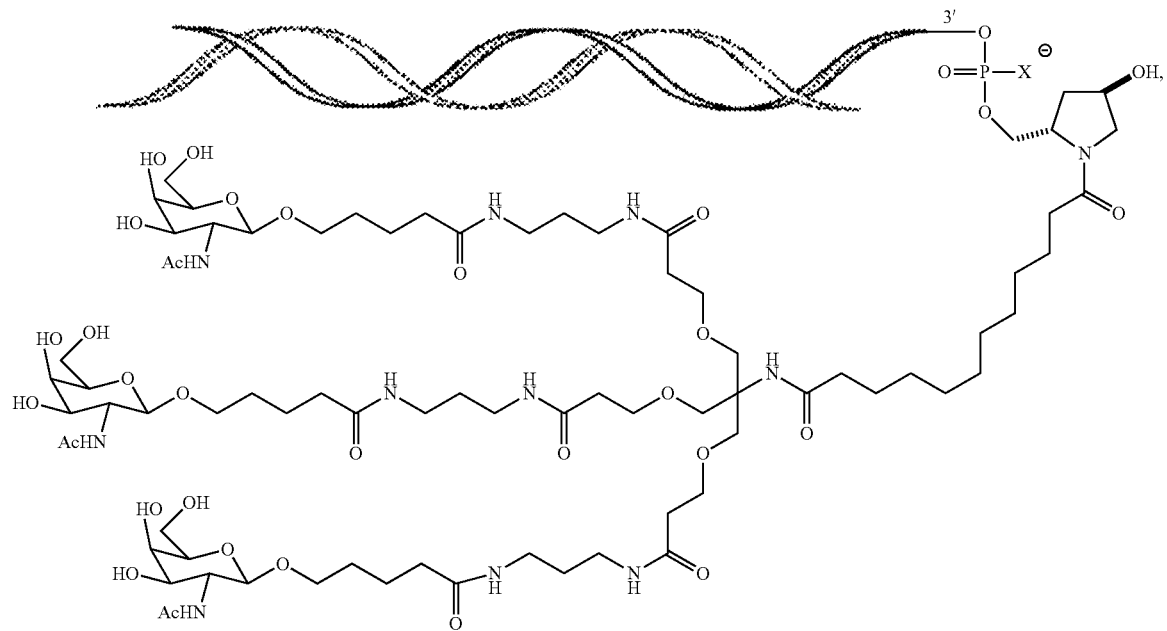
wherein X is O.
30. The dsRNA agent, or a pharmaceutically acceptable salt thereof, of claim 29, which is in a salt form.